United States Patent 12,576,115 (BACTERIAL COMPOSITIONS FOR TREATING AND PREVENTING HALITOSIS) - sequence listing, part 9

SEQ ID NO: 22 - DNA, 1994407 bp, unidentified
  source 1..1994407: mol_type = genomic DNA; note = Limosilactobacillus fermentum
caccactatggtaatccatcaacaagatttagtgtagagccattaatttccagttgggttgctaaatcgttttgtcccccaaaatcagcgacctcgctgagggtgacggtggtttgaaaggcgtgcgttatttcggccagcgcccgggattggttgtaggcttcgtgcattagggcctgaagctcctggttggtggttaggtagttgataatggataaaaacaagggtacaaagtcatgcttatcaaaggcggttagataatgccttttaaagagggccagtaacgtatcgacgtgagcagccaactcctggtcgtagaggtcaaagacatcgtggtaatggcccccgctccaggtcagcttcccgggtgatttcagccaccgtcaggcgaaagagcggtttttggacgatgaggcggtaaaaggcctctttaatgagacgttggctccgacgactgcgacgatcaaccatgttttgctccccttttttagcatagatttgccaatctgtcggttaacgaacggtatgccgcccgttacagatggtacttaggtgcttttactgtaaactattattgttcgttaaacaacatatgttcattaaagggaggaagagaaagtgggatacgcactattaagcctggcgatcggatttgggattttaggaacgaacctcctaaaactctccgttggtttcacacgggtagggatcggtataactagtttggcgtgctacggggttagtttttacctaatggcgttgtcgtaccaaaaattacccctaagcgtagcggagccaatctgggcggtgcttggaattatagcggcgacgttactggggcaattcgtgtaccacgaacgggtggccctagctcagtggttaggcgttcgcttgataatagtgggggtccttttagtaagctttaacaactccaactagtaattggaacaacggagtggtgatgaataatcaattaagcactatttggtgaatgaaaacggtgtcgacggggattgatggttatttcgggttggataaaattgtatatcacgggataaaatatacgtatttttcgcatatccgccgaaaaagatcgtatttttattaaaaaagacttgcctctttgcaagaaaggcggtactatataaaacatattcaagatatatacaatgattattcaattgaggaaagaggatcattaatatgaaggttaataagaaatggttggcgctactgtcgttagcattcttggtggtgattgggctcgccgggtgtgggaagaagagtgacgatagcctgcaacaaatcaaggacaagaaggtcttgacgatggggacctccgccgactacgccccgtttgaattcacgatcatgaagaacgggaagaaggaatacgtcggttacgacatcatggttgcccaaaagatcgctgacagcctcggggttaagctcaaggtgcaaaacatggaattctcctccattattagcgagttgcaagatcacaaggtcgacatcgccctggccgggatgaacgtgacgccacaacggaaaaaggccgtggacttttctaagccgtactacacggaacaagaatccctcctagttaagaaggccgacgccgataagtacaacacgatcgccgacacgaagggcgcttccttcggggttcaacaatcatccacccaggaaacgatcgctaagacccaaaccaaggcgaagctggtttccgaaagcttagtcaccgggttagcgaccgacctgaagtccggtaagctcgacggggtcgtcttagccaagaaggtcgcggaacaatacgttgcccaatacccggacacttacgccatcgccaaggttaagatcacggcaccggcatccatgaaggaaatttcaatcgccattccaaaggacgaaccgaagttaaaggctgccgtcaacaaggaaatcaccaagctgcaaaagtccggcgaattagacaagctcttcaagaaggcacaagagattcaagagcaaaacaccaacaagtagttagttaacagggggattgcacatgtttgattttctaggacaatattggccgctctttttagaggggaccgcccagacgatgatcatctccatcatcggggtcatcatcggcttcttgatcggcctcttgatggtcctgatgcggatgtccagggtaaagccgatttcatggatcgcacgggcctacatcgctatcgtgcggggaaccccgtcgatgatccaagtgatgttgatctactacctgttggcccgttccttgccactaccgcagacccaaattttggggtcgggactggaccggatcatcccgggggcgattgccttagggcttaactccggggcctacacggccgaaatcttccggtccgggatcatctccatcccggccggccaaaccgaagcgggcttgtcgttggggctaagtcaaaaggaaaccatgttctcgattgtgctgccccaagccctccgcaacgtcttaccggcgatggggaacgaattcatcaccctgattaaggaatcatccgtcctcttctacatcggggtgcaagaaatcactgccgaagcactcggggtggggggaaccttgtacaacttcatcccgcctctgttagtggccgccgtgatctacttcatcctcacccaggcgatggcccaattactgggctggctggaacggcggatgggcgctaagtacgaattaggctaacggataacgaaataagggagtcgtgacgaaaaggtcacggctcttttttgcgcttcgggggtcaaaatgaaggggggttcatggtccaaaataaagctgggcgccgcttttatccttatcgatcgattaattaaaaatagcgacgccccgactttggaacggttgactgaaccgcgaaaaggggggcgaccggggaacgggtaggggtggagctcactttggtccgctaagtgaaaccgggaaaaggactaagtggccgattgtttgactttgaccacaagatcttgtaattaacgatcgtacaaaaactagatgttgtgtcgaactggggagccccgtatgataatgattgaacgcgaaaggaatgatcaagatgcaagaaatcattactaaccaaaccctggcgcccttaagcgacgtcacggtcatcaaacggggtcagaccaagacccccttttacggctacaagattgggatggtcatgcgggccctgggcgccgatgagcaactcactaaaaacgttagctggtttttagtcaacgcctttagtgaccaggcaacggtcacgaccgcagagattgctaacgcgatttgcgccgccttgaaccgggctgggcgcaccgacctggcgaccgccttcaccgagcaccgccgccaagacgacgccagctttgacaaggccaccgacccccagcaaaagctcaaccaactctttgatgagaactcgcgggtcgtccacgaaaacgccaataaggacagcaaggtcttcaacacccaacgggacctggaggccggggtggtgtcccgggcgctagggctcaagatgatgcccgaagtcgtggctaaggcccacctgcgtggcgacattcactggcacgacctcgactactccccggtcaccccggaaaccaactgctgcctgattgattttgacgagatgctggccaacggtttcaagatcggcaacgcctgggtcgactcgccaaagtcgattcaaaccgccaccgcccagatgtcacagatcatcgccaacgtcgcttccttgcagtacgggggctgttcggccaaccggatcgaccaattgttggaaccctacgcgatgaagaactaccaaaagcacctggccgacgccaaacagtgggtggcagaagacaagcaagaagaatacgccaagaccaagactaaaaaggacatttacgacgccatgcaggccctggaatacgagatcaacaccctctactcctcccaggggcagacgccgtttaccacgattaactttggcctggggacttcctgggtggcccgcgaaatccaaagggcgatcttacaaatccggattaagggcttgggcaaggaacaccggacggcgatcttcccgaagttgactttcaccgtcaagcgcggcctcaacctgaacccgaccgaccccaactacgacattaagcaactggccctggagtgttcgaccaagcggatgtacccggacctgttgatgtacgacaagatcaaggagttgaccggctcctttaagaccccgatgggctgccgctcctttttgcagggctgggaagacgaaaacggcaaggaggtcaactccggccggatgaacctgggggtcgtgacggtcaacctgccgcggatcgccctggaagcccggggcaaccgggagctgttctggcagatctttgacgaaaagatgcgcctggccaagctcgcccttgattaccgaatcgagcggaccaagcaagccaagccggaaaacgcgccgttactgtacatgtacggggcctttggcaagcgcttgaagcggaccgattcggtcgatgaggtcttcaagaactcccgggcgaccgtttcgctgggctacatcggattatacgaggtcggggcgaccttctttggcccgaagtgggaagatagcccagcggcccacgactttgtcttagagatcgccaagcggatgcacgacctgtgtgccgactgggaaaaagaggagggctaccactttagcctctactcgaccccggccgaatctttgaccgacaccttctgccaagacgacctcaagcgctttggcaaggtcgaggacgtcaccgacaaggaatactacaccaactccttccactatgacgtccgcaagcacccgaccccgtttgaaaagctggcctttgaagaggacttccccaagtacgccggtgggggtttcattcactactgcgaatacccgaacctgcgccaaaacccaaaggccttagaagccgtttgggactgggcctacgatcacgtcggttacctgggaaccaacacttccatcgaccagtgctttgaatgcggttttaagggcgaattcgaagcgaccgcccagggcttcaagtgccctaattgtggtaaccacgatccggcgacctgtgacgtggtcaagcggacctgtggctacttaggtaacccccagcaacggccaatggtccacgggcgccacgaggaaattatccaccgggctaagcacatgacaggaggaatgattaagcatgccgcagcgtttgagagagccaaacaatccgatgcccaaagaatggctcgctaaggaccattcacaacaatacatcgccgattacaaaccctttaacttcgtcgacggggaaggggttcggtgcagtctttacgtgtccgggtgcctctttaactgcccgggttgctacaacaaggcggcccaaaacttccactatggcaccccctacacgcaagaattggaagatcagatcatcgaagacctgggtcacgactacgtccaagggctgaccctcttgggcggggagccctttttaaacacccaggtctgcttgaaattgattaagcgggtccgccaggaatttggccaccaaaaagacatctggtcgtggtcgggttacacctgggaagagctgttacaagattccgcagacaaactggagatgctgtccttgatcgacatcctggtcgacgggcgcttcttgttggccaaaaaggacctgacccttcagtttcgggggagttccaaccagcggatcattgacgtccctaagtccttggcaaacggggaagtcgttatctgggataagctggtgcactagggggccttatgaacgacgaattaattgctttggttgaacgggccagcgcccagaccgccccgtggctaggccagaaacgccagcttgctttgcggctgtttgaccgcctggcggccggcgccccggctttgttagccgactggcaaaccgaccccgacttaggtgttgaacaagggaccagtcgggggggcggcgacctagtggaacaaccgctcttgaacgtggcgccccaattcagtgaactcctgcaagaaaacctaatggaaaaggcccttgcttggcagggtaaccaggaaaacgccgcccacttagccctgttaaacggggggcgcttcttgtacgtccccgacggaaccgaacgcccggcgccggtcgtgctggccggggaacattcccaccccaatgttcacgatttgatcttggtgggggcgggggcgacggtgacgatcattgacgaccagccaatggcgaccaccaagccgtcctttcacgccacggaattgctactgggggaacgagcccacgttaacttctaccagctcagtgacttcggggcccgggtgagccgccaagtggtggcttgctaccaggcccagtacagccagttagcggtgacgacggtgttaggtagccacccggcccaggtcacccggttgaccaactggctggacggacaggaggcgcaagcagactaccaactccttagcctggtcgatgaggacagcttcccgcagattgagccgcactttaagacggccggcccggcggcgggggtccaatttagccagcgggccttcgccgacccaacggccttagtgaaggccctagcggccaccgccccacggatcatggtcgaccgggtcagtcagcgcttccattaaaatccgaactatgtaaaagcatttacctccgaacaatggggtaaatgcttttttaggcgaacaatcatatttacattagggaatggaggtgctaaaatcttaacattacctaagcaaagggcagcaagttcgctgcggaaagagagagaaaatggaaaatcaagttgagagttcactgattgttggcccggacgatccggtgccggctggcgaggcgaccttactagggttgcaacacgtcctggcgatggatgtctacgtgccgccgatcattttagccgggatgatggcgatgggggccgccgattcaacggggctgttgcaatcgaccttcctggcggccggggtcgggacgattttgcaaacctgcttctttatgaagatgccggtttcgcaggggccgtcctttgtgccgctgggggccgccgctggggtcgtcatggcgtcgggaggcctgaagggcaacgggatggcaaccctgctgggtgccctcgtggtcggggcgatcgtcttagtcttgctcggtttatccggggcctttcaaaagatcatcaacaccctggtgccggcggtggtcggcggaacgatcatcacctgcgtgggcctatctttgatcccctcggccttaaacgacaacatctttgaggcgacgggtaacatttaccaaaacatcgaactggcctccattacggccctcaccctcttaatttgcgtggcgatttcgattcgcttcccgcgggtgcaaaagctgtttaagaccggttcgatcgtgatcgccctcctggtggggacactggtgtccgcttcgatgggccgctttgattggaagtcggtggccgattcggcttggttctccttcccacaacggacgatgctacactgggggatttcctttaacctaacttcgattctgaccttcatcatcatctacgccatcctgaccacggaaacgaccgggacctggtttgcgatgggggccgttaccaaccacaagattacgagtcgccagtggaaccacgggatcatcggcgaaggactctcctgtttagtagccgccctggccggaacgacgccggtaactggttactcgaccaacgccggggtgatctccatcaccggggtcgcctccaagcgggtcttcatcgccgccgggagctggtttatcgtcttgggcttcttcgccaagttgtccgccttcttggcggcaattccggcgccggtaatcgggggggtctttgcgatcatcaccgtgacgatcatgctcaacgggttgaacgtcattcgtcagcaacaaaccggcgaatccgacctgtacatcatcggcttaccgatcattttgaccttggccctggtcctcttgccaagcaaggtaaccaacgcggccccacaaatgatccaatacttactggggtcaccgatcgcggtagcggcgatcacggcgattgtcttgaacctcttgatgccgtcacggcacaacaagttagcctaacttaattttgtagaaaaattcaccaccctcacgatttgacgatcacttggtcgctaaatggtgggggtgttttcgtggtcaacgttgatataagggcgctgcaccattattaataaaatatgttaaaaagttaacaaacgggctttaattatcgactgatatatgctaaaaccaacgtatattaatccgaaaggtagtaattagtagcatgaaaggttttgcaatgctgggcccgaacaagacgggctttattgaaaaagaggatccgaaggtggggagtcgtgacgccctggtgcggccgctcgccgttgccccgtgtacctctgacatccataccgttttcgaagacgccttagggccgcgggagaacatgatcctcggccacgaagcctgcggggagatcgtggaagtcggtagcgaagtcaaggacttcaaggttggtgaccgggttttgattccggcaatcacgccgaactggtccgacgtttactcccaagccggctacgctactgactccgacgggatgttgggtggctggaagttctccaacattaaggatggggttttctccacccggatccacgttaacgacgccgacgggaacctggccctcttaccaaaggaaatcgacccggcggaagcctgcatgctttccgacatgatcccaactggcctccacgcttccgaaatggcgggtgtgacctttggggacgccgtggccgtgatcgggatcggaccggttggtttgatggccctgcgcggagcggtgctccacggtaccggccgcgtctttgcggttggttcacgggaaaagacggtcgaagtggccaagaagtacggggcaaccgacatcgtggattaccacaacggccggatctccgaccaaatcctagaagccactaacggccaaggggtcgacaaggtcctgatcgccggtgggaacgccgccgatacctttgaagaagccgtccggatgctcaagccgggtggttcaattgggaacgtcaactacctaaatggtcacgacgacgtggttttcaacgccggtgactggggcgttgggatgggtcacaagaccatccacggtggcctgatgcctggtggccgcttgcggatggaaaagctagctcaactagtcgtaaacggccggatcgatccatcactgatgatcacccaccgcttcgaaggcttcgagaagattccggacgccatcgaactgatgcaccacaagccggctgacttaatcaagccggtcgtaatctgcaacgacatcgactaatttcaacacctttatttagtagaaacagcggttggggtttgcccagccgctgtttttagttcagggggtcctttgttgcagattacggcaatgtaacaaaaacggcgaaaaaccggggattttcacttaacgagggggaattgggaaaaattttggcgccaaactggggtgaaatgttacaaaaaccaaacgggcgggggaccgaggtgaaaagggtggtcaacctatacgcccccatggcctcgaaccccgaacgggcgttgccgtttgaattaagcttgttactgaaagttacaaagtggcggccgattgagaactgcttgtcactgcgcggtaacaaaaggcgggtatagtaatcagcataggaacgacgaacaaatactgatacgaaagaaaggattcattttaatgaagctcaataagaaagccttgaaacttaccgcaactgtcgccggcgccgttgcgttgggaaccgttgcaacgacggtgtccgcaaatgccgattcaatttacaccgttaagagtggggacacgctttccggaatttcttgccagttaggtcacgattatgccttcgttgacacgctcgcctccaacaacaacatcgctaacaagaacctgatctacgtcgggcaaaagttagtgatcaaagatgacggtgaaattgcttcggccaccgccagtcaagtggcctcactgccgtccgctagcgctagttcaactagccaagcccaaaccgacagtgcctccgccgctagccaagcaagttcgactgcctctgaccaagctagcgcagatagtttagccgctgcccaaagtgccgctgccgctagtcaagccgctgcccaaagtgccgctgccgctagccaagccaccgctagtgaagctgccgccagcgccgccgcagccagccaagccgccttgcaaagccaacaggccgctagccaaagtgccgccgctacctcaacggcctacacgacgatggcagccacttctacaaccactttgacttccagcaccagctcctacacgactagcctgagctcatctgaagaagcagcgaaggaatggatcgcccaaaaggaatccggtggttcttacaccaaacaaaacggtaactactacgggaagtaccaactttccatctcctacttaaatggggacctgtcggccgctaaccaagaaaaggtggctgatcaatacgtagcctcccgttacggctcttggaccgcagcccaagccttctgggaaagccaccgttggtactaaaataggagtgcgatctagtacccaacagatcagagaacattgataaaaagaccgggagcgctaatctcccggtcttttttcgtttttaaggttggggtgtccaaaggggaccttagtcgggtacaatagaaggaaaatgaaaggggtgccaacgtggtaaaagaaattacttgtaaccagacccgggtggtgacgacccaccgggtaatgagcgccgatttaaatgaacacgagacgatgtttggggggaagttactcgccatggtcgatgccgaggcctccctggcggcggtccggctggcccgggggacggtggtgaccgctagcatggatcacgttcagtttacccggccctttgtcctgggggacgcggccgaactccaggcctttgtaaccgggatcggtaagcggtcaattgaggtctttgctaaggtgatcgttgaggaaatggccaccggcaagcgcacccttggcttttcgtgctttatgacctacgtggccatcgatgaggctgccaacttcaccgattaccgtttaattggcgaagatgatgagcaagcctttttgatggagacctaccaaaaccgccgtgagcaccggcggacggaacgagaaaacctggccgccgtcaacgcccacgtcaacttagataaatgattttttgttcatattatcaaaaaataaatatttaaaaagtgggggtccaaagcaccaaaaagccggttgacgggtgattagcgagtcagccaaagccgtgatttagcagttaacaactcgcactgctaaaggggcttgcacctgcaattaaatgtgctatgataaagatgttgaaggaaatataaaaagattcgtgaaaggaagtcttatcatggcaaatgaattacaacgtaacaacggcctctttggtgacatgatgcaagattggtttgacaacaacttctttaacaacgtcaacctgccgtttaacagtaactacatgaagaccgacattgaggaaaccgctaagcaataccgggttaaggttgacatgccaggctttgacaagaaagacattcacatttcctacaatgacgacctcctgacggtcaccggtcaccgtgacaccttcgatgatgagtccgacaaggatgggaacatcctccactccgaacgccgttacgggcagatgagccgtcagtaccgcttgccaggggtggacttggaacaggttaacgctaagtacaccgatggggtcttgattttgaccctgcctaagctgactaagcaggctaatgatggtaagcacattgaaattgactaattaaagtgtgtggtagcacgcagaaaaggctgagaacgctcattgctctcagccttttgttgtggttgcaaatgataggcagaaaaaaagtggccaacaaccaaagcccacgtgtttaagcaggggcaaaggtgattggccactctttttgcgattaggagttgaagtggtggcttggttgattggggtcggcttgctcgtcgaagttagtcaagtagatcaattccaccggggagtgggtttgggcgtaccccatgatctcacgcagggcgctggttgagatccggttatcggaacgtacccagtggacaataatgttggtcaaagtcccggtgtagatttcaaataggtagtcaaccgggatcggtgacgggtgaacattagtagaggggtgctgactattgaagtaaaacaaaagcttgccccggtgcatgaactccgagtaagtggtccgcttgatccgggtgagcaggttaatgtcgctgtttggggacaacaggatccggctgacttcccggtaatcgctgcaaacctggacggtgtgggcaaaggattcctgggagaggcggaagatttcttccttgtctggaaaggagctgtgctgggttaagcacttacggtcctcttttagggcctcttgtaagtcggtaatgatcgccccttcaatttccattaacaggtcgcgttttatccttgtagtatgtgtaaaaggtcttacgactggcctcagcggattcaatgatatctttggtggtgatgtcattgaggggcttttgctttaacaagatcactaacgaagacggccggacgacgatggtgtactggggcgccatgctagacgagctgaacatgtaccgggagtggttagaagctagaagcccacgacctgtttgacgcttgcaaggccacggccaacatgttcccagatctggaagcttctcgcaaccaaccgctgtcctttaagaaatttgacgaaattgtcgctaagaccggtgaccaaattggcgccccgttttgtgctgactgcgcccaacggatcggtgcttacgaactttaccaacaaaccaaccaaagcgtggaagcactaatgacggttctcgaccttccgtgggaaggaaacgccctcgacttcattggcaaagaggttacccttccataattttattaaattatttatgcaacccgaattcaagaaagcggccaagagaaaccgagaattctcttggccgctttttgattttataaccggtctactagaaggctattgcccgctttgttcttggagccattctaggaaaacgcgggccatttcagagggctgggcgggggctaggaagccttgggaactgagtagggccggggaaaggccgaataattggcagccgaccggtaattcagttggtaaagaggactggggagcaagcgtggcccccaggaattgggcaaccttagttaagcgcaggtcgagggcgtcctcttcttccaccgacggcagcggggtaccggccatcttaaaattagcgtccagttcccggcggagcgggtgaccctggctaggcaagaggaggtcttgttcggcgagttggtctagactaacggtggtggccatggacagccccagttggctaactagtggggtgggcaagacggccaggtagggttcttggtctgtaatcagggcgtgggcctgattagtcaaaccggccgcaaagattaggtcgcattccccagttgctagggccgcagccaggtgggccgtgcgggtggcgaaactaaccttgatatcccggtgcccttgcataaagcgggttaagagttgaaagccctttgtcttagggaagtctggttgggcgaggataaaaagtcgcttgtctgccatgttggccccctagttgatccccttagggaagtcacggtcgagctcctttaaaaggggcacaagcagggtcacgtactcgtggtaggcggcaatcgggttcttggggtcggcatttttggccatcagggccagggcgatgtcgtgggcccgttgttcgtttgatatcattaataatcacctcaaggatagtgtaccagattttagtagtggtgaagcgaccacatttctcctatcgcatggggaccgaaatggtgtataatgaagtttctattaacgtacggtgagaaagcgccgaaaattaagcttccatattcgacagaagaaaggaatgaggattatatggctgatcatcatcagcaaaccagcgggtccgaagagccaaagatggcccgcaacctcaagaaccgccacgttcaattaattgccctggggggaacgattgggacggggttgttcttggggtctggccagtcgattcacgcggccggtccgtcaatcctgttagcttacatcatcaccgggggcatggtcttcctgttgatgcgggcgttaggggagctgctcttatcagacttacgttaccacacctttatcgaagcgatccgcgattacatgggaccgcgggtcggctttgtggccgggtggacctattgggtctgttgggtcggaattgcgatggctgagattacggcgatcgggacctacatcaaactgtggttgccgggtttaccccagtggatccccggtttgttgaccctgatcatcctcttgtgcttgaacctgattacggtatcggcctttggggaagtcgagttctggtttgccctgattaaaatcattgccattgtggccctgatcatcgtcgggatcgttttaatggtgattggttaccggggggcgaacccggggaacctggtgcactacggcggcttctttgccaccggctttaagggccttttgatgtcctttcaaatggttatctttgcctttgtcggaatcgaaatgattgggatgacggcggccgaaacccaaaacccccgcaaggtgattccgcgggcgatcaacgacatcccggtgcggatcctgctcttttacgtcggggccttgttaatcattatggccatctacccgtggaacaagctggacccgacccagtcgcccttcgtaatggtctttaaagacatcgggattcggggggcggcctccgtggtgaacttcgtcgtgatcacggcggcggcttcggcctgcaactcatcgttgtacacgaccgggcggatgctagcggaactgacctccgactcgccacggccaagcgtacgccggattgctaagctctccaaaaagcaggtcccggccacggccgtgatcgtgtcggtgatcgtcgtcgggtgctcggtgatcttaaactacttggtgcctagccaagtcttcaccgtggtgacctcgatgacaacgaccgccttcttattcgtctggaccagcattattctggcccacctgaagtaccaccggcaaaacccgggccaacgcgaatttaagatgccactggccccgtttaccgactacctcttcttggccttcatggccgccatggcagttgtcctttgcatgagcaaggaaaccttaccgtcggtaatctcggccgtgatctggttagcggcgctgggaatcatttccctgtccaagcgaccaactaaattgcattaaagagaccacaaaaggggctgtgacatgcgtcacagccccttttttaatctctaagtttcgccccacggcctactaactgattgttggccacttctattaacgtacccaacaaccgcaggcctagtgtctaagtacggacggagaacgatgcgtttcgcatcaacccccgtcctagcttagccccacggcctgctgagaggttgtcaggcacttcttttttagcgtgccaagcccaacttagcctggcaatccgggcacagaccgtggacctccacgtccgtacgggtgaccaggtagccggtttgatcgcgggtgatggtcccgagtgacttagcgaggtcggcaaagcgctcgtcaaacacatcggtaatcttagcacaggagtcgcaaaccacgtggaagtgggggtgaccaaagtaatcgtagtgggtggcgccatcgccgttatccagttcgatcactaggttgtaagtcaccaacatcttgagggtgttgtaaaccgtggccattgaaaggccgtcgtcagtcttttttaaatcgttgtagatcatctcgacgcttgggtgggtatggtgcccaatcaagtagtggaggatcgctttgcgttggggggttaaccgtaccttgtgctcatgtagccgctcgagggcgtgttggaattcatcgttggccatttgatcactcctttataatcattttaaattaaccctagtatagcatttacatttttaaaatccaaacatataatggggggcaaagggaattttataagttttctaaagaagaagggattcgatggaaacgcaaattgagccctccagccactcatttaaccggctgggtttcatggccaccctcttggtggggaccttcacgatgtcgatcagccagtcatcgctgtcaacggcgtacccgaccttgatggctgactttggtatttcggccagcaccgttcagtggctaacgaccggctttatgctggtaatgtgtgttgcgatgccgattagcccctggatgctaaacaacctgtcctttaaaaagatgttcatgggcgccttagccctctttgacctgggcagcctggtgatcgttttgaccccggttagttggggggcggctggcttttggtttatgatggttggccgggtactagaggcctttgccgtcggggtactcttcccatcttaccagaccgttttgctagaaattaccccggaaaaagagcggggcaccacgatggggattgctggcttggtaatgggatccgccctagcggtggggccgatcgtgtccggtgttgtcctcaagtatttttcctggcagagcctatttatcttctttatgatcgtgatcaccgttatcttcgccttggcgggagccggcctgattcaagacataatggaacgccaccagagcaaattggattggctgtcggtgtttctcctgctgggcttgattggtttaatgtggggaatcaaccaggtgggcaaggcaggggtcaattgggacctggccgcgacaccactggccgttagcctgctggccctcgcctggtttgtcgtccgccaacttaaactggcgaccccactactggagctccgcgttttaaaaacctttaactacgacttggccgttttattgacctcgatttcatacattgccttaatcgtcaccacgatcatcttccccctgtactatcaaggggtactgggggtgagtccctttgtgtctggaatgagcctggtccccggagcggtcttcttatcgattttgaatccgctcagtggtaagctagcggaccggattggctttaagccgacgatgttagtcgggatggcgatgatcatcatcggttggggggcgggaatcttagtggttagtcaacacagcttgatgggaatgctcctttgtgcgatggtgattgaagggggcaacgcctttgtcatgatgccggccgttaccctgggtgccaacgccttacccgaccgcttggtggcccacggaacggcggtaattaccaccgttcgccaggtgcttggttcggcgggggtggtggtcgccaccatggtgttggccaacgtgacgaaccgggttggtcaaagcggtgttagccactcggccgctagtttgacgggctttcgggcggtcttttccctgatggtgcttgttgaactggtcgggctgttcctagcgttgctattaaaagacacgaaaaagaagcccaattaaaaaagttgccgtatttaaagggtaaaggagggattgccatggttaaccgaccagaatgggcgcaaaagtcgcccgccatgcaagcttactacgatcacgactggggctttacccaacacgacgaacaaaaactctttgagatgctgtgcctggagtgctttcaatcggggctcagctgggccttagtttggcaaaagcgcctggccctgttagaagcctaccagggctttgatccggccaaggttgcacagtttggcgaagaagaggtcgccaagctcttagccgacccggccctgatccgcaaccagttgaaggtacgggccacgatcaataacgcccgaatcttaagccagtggcaccaagagggacgcaccctggaacaatttacctggtcctttaccaacgggcgttcgattcgcatggagccggtaccagggctgcccttaccggccaagacgcccctgtccgaacaagtggcgaccgaatttaaacgggccggctttaagtttaccggcccggtggtggtgatgtcgtacttaacggcggtcggggtaatcaacgcccgccttgcttaggcctggagcggtggtcattgacggccaagtagtttacggcacacaaaaaaggagctaggagggaataaccctgctagctcctttttgatttgattaggtccagtagattaaaacgatcgtgactaactgggcgaggttggcgtaaacaaagttccaatacttttcccgggtggtgggcaagatgaccatgaaccaagcgcccaaggaaataatgagggcgaaaatggtcgccacgctcagcgggtgggagagaatggcggcggcgtacaaaaggccggtcacgctttcgaaggggactaagtgcttaacgttggtgatgaaaaagggcccgtaaaaaaaccagattgaacaggccaacggcacaaagtaacggacgatcacccaggacatgaagtgcgtcgaggtaaaggcgcaggcaaccgggatggttaaggtgatgaggataccaagggtgacgagcctcagccccccgcgcaggttaatgttcggcaactggattaagactaggtaggccggcaagaggatcaagagggtcaaaaggatcggcgacttgagaaagccaatcccagcgaagattacgctcaaggccagggggaccaaggacagctgggaggcgaagtggtggttaatcgccagggtaatagcggcgccgatgcataattcatataaaaaaagcgggccgaaatggctggtgaagtgggtcccgtcaacgccgaccacgtaggcgaagggggcgtatgaccaggtaattaattgaatgcagatggtcggcaaaaggtcttgccaatcggtggcgtgaacctgcgccttgagttgattccacattagatttacacgtccttttcaggttttgacattgaccttagtataacaaagattgcgaatctttaattgaaagttaatagaaaaatatgatattattgcccctgttatgaagcaattcccgatggggggagcccagtgctccgctgccttgtaaccgcaaaacactatgtttagaaaatgggggaattatcacatgaaagaacgacacttattcacgtcagaatccgtttccgaggggcacccggacaagatcgccgaccagatcagcgatgccatcctagacgccctcttagaaaaggacccggatgcccgggtggccgttgaaacgtccgtgacgaccgggttggccctggtcttcggggaaatttcgacctcggcctacgttgacatccaacacgtggtgcgtgaaacgatcaaagagattggttacacggacggtaagtacggttttgacggggataactgcgccgtcatcgtggcactggatgaacagtccaaagacatcgcccaaggggtggacgactccttagaaatccgggagggtcaagtagacccactcgaccaaattggggccggagaccaggggttgatgtttggctttgccaccgatgaaacgcctgaatacatgccgctgccactaatcttatcccacaagttgatgcggcggatcgccatcctgcgcaaggataaggtcatcaagtacttacgcccggacgccaaggccgaagtaacggtggaatacgatgcagacggcaagccggtccgggtcgacacggtggtcttatcgacccaacacgacccagacgtttccttggaacaaatccaagcagacgttaaggaacaggttatcaaggccgtgattccagctgaatacctggacgatcaaaccaagtacttcattaacccgaccggccgcttcgtgattggtggtccgcaaggggacgccgggttaactggacgtaagatcatcgtcgatacttacggtggggccgctcaccacggtgggggggccttctccggtaaggacgccaccaaggtggaccgttcggctagttacgccgcccgctacatcgccaagaacttggttgccgctggctacgcaaagaagctggaaatccaagttgcctacgcgattggggtggccaagccggtttcaatttcgattgacaactttggtaccggaaccaagagtgaagaagaaatgatcgccgccgttcgtcaagtctttgacctccgaccggctgggattatcaagatgctcgacttacaacggccaatctacaagcaaaccgctgcctacggtcattttggccggaccgacatcgacttgccttgggaaaagttagacaaggttgcggaattaaagaaaattttgggctaataaccaatgaaaaacgtggcgggggtcatttgtgaccttccccacgtttttttctttgcttgaccggtacgaaaaaaacgggtaccctatgattaacaattaagaaccgtctagagaggtcagtcaccggctgcaagctgacccatgcgttcgaaacccgctggactaagtccaaaaaccgaatcaaattaaaaaagcgtgaagctcgtcttcaaatggggatggtaccgcctgcaagggtgccccaattgaaggcgggcttttgttttaaggagaatgattatggcagataaagaacgaattgtggttaagattgggacctccagcctaatccaagaaaacggccgggtcaacctagcctccatcgaccggttagcctttaccctagcttgcgttaacaaccagggataccaaccgatcctggtttcttccggggccatcggggtggggttagccagtttgggcttgaccaagcggccggcggaaatcgcccgccagcaggccttagcctcgattgggcaaaccgagttgatgcggatctactcccaacgcttcttggattaccaaactaaggtcggccagatcctgattacccgggacgtgttgaccttcccggttagcttgcaacacgtaatcgacaccttcgaggtcctcttggccgataaggtaatcccgatcgtcaacgaaaacgacccggtcgccgttgacgaactcgatcaccacaccatgttttcggacaacgacgagttatcggctcaggtggccgtcaaggttggcgcaagcaagctgattgtcttgtctgacatcgacgccttttacgacgccgatccccaccaagaccccgacgccaaggtgattcgccacgtcgaacagctgacgccggaaatggaggcggccgccgggggcagtggcagcggcctgggaaccggggggatggtgaccaagttgcgggcggctaagacgatgttggctgcgggcaagcagatgattttatgtaacggtaaggacccggcgatcattaaggacgtacttgccggtaaggaaattggaactcgctttggaaaggggaattaaccatgacgatgatggaagaaatgggccaacgggccaaggaagctagtcaagtagtagcgcaattaaccaccaagcaaaaaaacgacgccttactcaagatggccacggccttacgggctggccaagcaacgatcttggcggctaacgaggctgacctcgctagtgcaaaggagatgccggccaagtttgtcgaccgcttacgcttaacaccgcaacgaatcgacgacatggcaaccggcctagaaaccgtcgctaacttagacgacccggtggccaagatcgaccgtggctgggtcaactacgccggcttagagatcatccaacggcgggtgccattgggggtggtgggaatcatctttgaggcccggccaaacgtgaccgccgacgccaccgccttgaccctcaagtccggcaacgccgtgatcctgcgtgggggcaaggaagccgcccggtctaaccaagcgatcgtggcgtgtttgcaagcggcgctgacggaaagcgggttgtcaaaggatgcggttcaactggtggaggaccaaagtcacgcggtcgccacggaaatgatgcacctcaccggctacatcgacgtcttgattccccgtgggggcaagggcttgatcgcccgggtgttggagacggcgaccgtgccggtgattgaaaccggggccggtaactgccacatttacatcgaccagagcgccgatttggccgtggccgcaccgatcgtggtcaacgccaaggtgcaacgcccgtccgtttgcaacgccgccgaaaagctcttggtaaaccaggccgtggccgaagagcagttgccaagcctggtggccgccctgcgggaacacggggttgaggttcgcggtgatgagcgggcccgggcgatcgtcagtgacctggtaccggccaccgacgccgattgggataccgaatataacgatttaatcatggccgtcaaggtggttgacgacctggatgaggccatccagtggattaaccagcactcgacccaccactccgaggcaatcatcaccaaggacatggagcggggccgggccttccaacagcgggttgattcggcctgcgtctacgttaacgcctcgacgcgcttcaccgacggtagtgagtttggttttggcgccgagattgggatctcaacccaaaagcttcacgcacggggcccaatggggttggcccagttaacgacgatcaagtaccagatcaccggggacggtcagatccggcaataaggcgtgttggttgggcgccccaatggtggggagtgccgcactgaggagctgaaatagttagaaaccttaaaggggccaggggaaagcacagctttctcctggccccttactatattcacgaatgttagacagaaaacgtggtcaataaccgcaggcctagtgcctaagtacggacgaagaacggtgcggtccgcaccaaccgttcgtcctagcttagtcatacgacctgcttcggaggttattttccactctccttatttagtaccgccgggcccggggccggtttgaccgtgggcgcgggcggcgacgcttggcccgctgaacggagcggacctggtagggtaagaagcggtgaaagagggcgtcaaaaaaggcgaccacggtaatccctagcgcccaaccaccgatgacatcggacaagaagtgggcaccaacgtagaggcgcgaaaagccgatcaaaagcgcaaagacgaccgccaacgttgccagggggtggcggtacttagtcggccacttggtccgcaagattaacaggactaaggaccccatcgtcagggcgctcagggccacgtgggccgaggggaaggaccagccaccgtagtgcatcaagacgtcgttagttggccgcgggcgctgaaaaagggacttgaggtagtggttaagccaagagccggtggcgaccgttaaggcgacctggagcccggcccgccagctaaagccgagtaaagccaccagggtgacgaacccggtgatgatcgtggtaccggtggagttgtaagctagggtgaggtgggtgaaaaaggcggtcccccagttagtgcggtgggcgttaactaaagaacggagcgccgcatcgttagcgttgagggctggtgcgtggcttcccaccagccacgcacagagcaaaaagatcaccagggcgctggcgccaatggttaacgataaagacttgtaacggttattcaaaaggtcctccagaagggtgcgcatttttaacaaagaaattaaaaggagcgcccacgtgtcaaaatttatggtatagtggtaaccataatatcagaccggaaggggaaaagtaacccggggcgacccttaaagagaccacatggggctggaaatgtggagggcaagccgggtgaactcaccccgctaaagggcggtgaaaccagtagtcgtcctcgtttcccgcgttaaggggctaagggccacggcaacgtggaacgatgggtggtaccgcggagaaattcgtcccgtttgtgttaagcacaacggggcgtttttttgtcccttccggtttagtcacgcgaattgattggaggatttgatcatggcatacgatcacaaagcgattgaaaagaaatggcaacgctactggaagcaacacaagacctttaaggccactttggacaaggaccaaaagaagtactacgccttagacatgttcccgtacccgtctggtcaagggttacacgttggtcacccggaaggttacacggccaccgacgtgatgtcacggctcaagcggatgcagggcttcaacgtcttacatccgatgggctgggacgcctttgggctaccggcggaacaatacgccttaaagaccggtcacaacccggctgacttcactaaccaaaacgttgaccacttccgcgaccaaattcaatcacttggtttttcctacgattgggaccgcgaagttaacacgaccgatccgaactactacaagtggacccagtggatctttgagcagctctacaagaagggtttagcctacgaagatgaaatcatggttaactgggcacccgacttcatgggcgggaccgtggttgccaacgaagaagtcgtcgatggtaagaccgaacggggtggttacccagtttaccgggtaccgatgcgtcagtgggtcttaaagatcaccgcttacgccgaccgtttgatcgatgatttggacctggttgactggccggaaagcgttaaggaaatgcaacgcaactggatcggccgttcagagggggccagcgtcaagtttaaggtggttggccacgacggggtcgaaattgaggtctttaccacccgggccgataccctctttggtgcttcctacgtggtgctggcaccggaaaacgaactggttgaccaactgacgacgccggaacaaaaggccgccgttgacgcctacaaggaagaggcgtcccggcgttccgacctggaacggaccgagttaagcaaggaaaagaccggggtcttcaccggtgcctacgtcatcaacccggttaacggcgaacagttaccaatctggacggccgactacgtcttgaactcctacgggaccggggcggtcatggcggtgccatccggtgatcaacgggactttgagttcgccactaagtttaacctgccaattacgccggtggtcgaaggattcaatggggaagaggcctacaccgaagatggtgcccacgtcaactccggcttcttggacggcttaaacatcaaggaagccaaggccaagatggtggaatggctggaagaacatgactgcgggggcaagaaggttaactaccggctccgtgactggatcttctcgcgccaacgttactggggtgaaccgatcccggttatccactgggacgacggcacgacttcattagtaccggaagacgagttgccgttgcgcctgccggaaaccgacaacattgaaccgtccgggaccggggaaagcccgttagctaacatcgaagactgggtcaacgtctacgatgaaaacggccgccacgggaagcgggaaaccaacacgatgccacagtgggccggctcttcttggtactggctgcgttacaccgacccgaccaacgacaaggagttcgcttccaaagaagccctcgactactggtcaccggttgacctttacgtggggggagccgaacacgccgtcttacacctcttgtacgcccgtttctggcacaaggtcctctacgaccttggcttggtaccaactaaggaaccgttcatgaagttggttaaccaggggatgatcctgggctccaaccacgaaaagatgtccaagtccaagggcaacgtggtgaacccggatgacatcgtcgaccaatacggggccgataccctgcgcctgtacgaaatgttcatgggaccgctggaagaatcggtgccgtgggatgaaaagggcctgcacgggtccaacaagtgggtgcaacgggtttggcgcctcttgatggacgacaacaaccacctacgcgaccgggtgtccacctacaacgacggtaagttgaccaaggtctacaaccaaaccgttaagaaggtgaccgacgactttgaacggatgcactttaacaccgccatttcccaactgatggtctttgtcaacgaagcttacaaggttgacgacttgccgttagagtacatggagggctttgttaagatgattgcgccgttgatgccgcacctggccgaagaactgtggagccaattcaacgaatcagaaaccatcacttaccaaccgtggccaacctatgacgaaaaggccctggtggaagatgaggtcgaaatgatcgtccaggttaacgggaaggtccgggccaagattaagatggctaaggacgccgataacaaggacgttgaagacgctgccttggctaacgagcacgttcactcctttgtggacggcaaggacgtcaagaaggtgatcgtgattccaaaccggatcgttaacatcgtcgtgaagtaggaagtgcgacccaatctattaaacgggccgtgggctaaggataggacacaggttagcgcgccagcggtgttctgtggccagacttaggcactaggcctgtgattggggagcacgttatcaggaagtgcggaccaacctatcaaacaggccgtgggctaagggtaagacgcaggttagcgcggcacgcggtgttctgtgtctggacttaggcactaggcctgtgtttggaaagcacgttatctttgggagtgtgacccaacctcctcgacgggccgtttgactaagctagggcaagggttgatgcggaaagcatcgttccttgaccgtacttaggtactaggcccgtggttggggagcacgttatctgtctaacattcgaacacacggtaagaggctggggaaactcgtagtttttccaaccttttcttcatttggtaattaaaatggaactaacaacctatccagccgtcattaaaaaaacatcgcagggctataccatccactttccggacctaccggatgccgacgtggtggacgaagaccttgaccgggcccgcctgcgggcaaccattggtctagcgataatcattagcgacctacaaagccaccgcgaaccggtccccgcgccgagcgaccaacgggaaataagtgagcagtaccgggactttcacgtggaacttatcaccactgatttagataagtattgataagctaagtgggggacaaaggggagcggtagttaaaagggtttgcgacccccattaaataaggctagaataagggggattgtaattttttaaaaatcgaggaaagaaagatatggattcacgtaatcaaccgggggcttcttccgcctcccttgacgattcgcggcgcaaaatgatctccggttctgcatggatgacggcgggctcgatcctctcccggattttgggtgccatctacatcatcccgtgggtgacttggatgggggcctattctaaccaggccaacgccctctttgctaaggggtataacatctacagcctctttttgatggtcgcaacggccgggatcccctcggcgatttccaagatggtggcccactacaacgggattaaccagtacggggtatcccgccgcttgtaccactcggggatgtacgtctcggtggcgatggggctggtctgctcgatcctgatgtttttcggggcctccctgcttgatgggggcgacccggatgtaattccggtcattcagtcgctagcctgggcggtcctcgtgatccccggcatgagcatcacccggggctttttgcaggggtacaactggatggccccttccgccatgtcgcagtttgtggaacaactgttgcgggtcatctacatgctgctggccaccttcgtgatcatggagatgggcagtggtaactgggtcaaagccgttacccaatcgacctttgccgccttcatcggggcgttggggtcaattgtcttgttagcctacgcctttttacggcgcaagcgcgagatggacgccctggtgagccagggtgaagtggcgacgggggtgtcgacccggcggttaattggtgaaattatttaccagtcaattccctttatcgtgattgaatccgggatcaccctgtttcaattgattgaccagtacaccttctttgacatcatgaagtggtttggcaactacagcgcctaccaactcaacacggtttacgccctgttctcctttaacgccaacaagctgtacatgattatcatctccttagcttctgccatggctgccacggcgatcccgctgttggccgaggcccgggctaaaaatgacattcaagacatgcggcgccaaattgaaaacgccctgctgctcttttacttcatcatggtaccggcggccctagggttagcggcggtggcccaacagatttacacggtcttttaccgctacgacgcggccggcatcacggtgttgcagtttgccgccttcatgtcgattccgtacgggatgtacacggttggggcggccatgatgcaggggatctccgaaaacaagaagatgatgcgcttcttgttcgtggggatcatcattaagtttatcgtgcaagttcccgccatctggctctttaaggggctggggcccctgctggcaacggcggtggcgatgctgtttatcaactactgcatcctgcactcctttaaccgggagttcaccttgcacttcaacgagatggcccagccaaccaaccagatcctcgccttttccttgatcatgtttgccgtggtcaaagtggtgatgctcttgttggggctggtggttagtccgtacgggcgcttcaccgcctttttcaccctggtaatcggggtggtcatcggcggtggggtctttgcctacctggcccttaagtaccgcttggttgataccctactcggtgatcgcttcgccggcctgcgaactcgtttccatattaaataaagaaaactcccgccgctcgggtttcgagctgggcgggagtttttctataggtcggctaaaacggactggtaaaggttagccatgttggcgatgatttgttgaccggcctcgcttagcttagtggcgttgggaaaatcgtgcgggtcacggtagagggccttggtgtggtcgccttctgccaccagtaacagtttaattggtaactcaaaggcgacctggtcgtcttcttgcatcaatagggtaccaaccttagggttaccaaaaatcaagaggacggtgggtttcagtgttagaccgacgttttgggcttctgcagcctggtcgatggcggcaaagattttaaagccccgttggtggaggcggtcctcaatggcttgttgtgcggtagacagcgggctggtcaagtgaacttcttttaacatcttaattccccccctaaaaaaccaatgtggtgggtagccgggccttgttcaacctttttcatgaaggagggcaaagccgttgcaatttgggtgggtaaaacaatgtattggtctttggcaatctgatcggcgatggcggagtgggcgtaaacggcggctaagacggcctggtcgccagcctccttaaactgggcgtaaaagccaccaaccatcccggccagggtgtcgcccatcccgccaaccgcttgggccgccgaaccgattggcaagcggaaggtgccgttggcagtgtagatttcggtgtggtggcgcttcaaaacgacggttccccccagtttttcttgggccgcttggttaagggcttctgcttggtccttgattgggataccggagaggcgttgccattccatttggtggggggtgaagactaggtgaccggccggcgccgctagttggtgggtggccattagggtaatggccgagccgtcaatcaccacggtttgggtgggcttggtatttgcaaaaacggtctttaacaccgcaagactttgctcctcttcccccaagcccgggccaacgacaatcgtatcgacgccgttaagcatttcaagcagggcggcttggttggaaaaatcaatcaccatcgcttcgggaagccgggcgtgcaaggcggtccggttgactaggtcgcaggcgaccgttaccaggccggccccggcgttgacggcggccgtggcggccatgatgatcgccccgccaaactggtggttgcccccgaccaagaggaccttgccaaaggtgcccttaaagctttcctggggccgggtggtgatcacatcttgtagtatctgttcagttaaatccttcatttaaattccccctcggctgaaaacgaattcagggggaccattttagtccccgttagctttatggtatcattatctgtaacaaagtgaacatgatggagggtaaaaaaatgaccgattggttaaaagaagctaacgcacaaagggaagattacctaaccgacctgatctccttgatgaaaatcgaaagcgtcagggatgacgaacaggcgaccgccgactacccactgggacccggcccggcccaagccctagccgcctttttggaaatggccgatcaagacggtttccggaccagaaacatcgataacctggtgggctacgccgagtggggggagggtgatgaaacccttgccatcttagcccacttggatgtgatgccggccggcaacggttgggacaccgatccctttgacccggtgatcaaagacggtaacctgattggccgcggtgcttctgacgataaggggccggggatggccgcctactacgccttgaagaccttaaaggaccagggggttcacttcaacaagaaggttcgtttcatcgtcgggaccgacgaagaggccgattggaccgggatgcaccgttacttcgaggttgaaccggcgccgacctttggtttctcaccggacgccgagttcccggtgatcaacggggaaaagggccaggtttcaatgctcttggacctgccgggaggcaacggcgatggcgacctgctgaagtcctttgacgccgggctgcgcttcaacatggtaccccgggaagcaacggcggtcgtggaagtcgccgacaacgaggacctggtcacccgcttcacggcctttttagacgaaaacccggttaccggatccatcgaggttgaacccgacggcgcccacattgaagtgatcggtaaggccgcccacggaatggaaccggaaaaggggattaacgccgccacttacctggccaccttcttaaagcagctccagctcggcgggtttgccaaggactttgtcgcttacgtggccgactacttacacttagacacccggatggataagtttaacgccgcctttagcgacccggtaatgggggaaatgacgatgaacgcggggctcttgagttttgatcaacaaaccggcgcccacattgacatgaacttccgctaccctaaggggattaccccggatgaaatcaaagcggcggtggcgaaggtggccgaaccgctacacttcaccgttacctaccaaggcggggaagttccccactacgttgacccgggcgacccgctggtgcaaaccctgatgaaggcctacattcaccagaccggcgatcagggggtccagccagaagtggtcggcggcgggacttacggccgcctgatgaagcgcggggttgcctttggtgctttgatgccgaccacgaccaacaccatgcaccaggccaacgaattccaaccggtcaacgacctgatcatgtcaatggcaatctacatggaagccattcacgacctggtcactgattagggaacggtttcattgtacggtttaccgtggtaaaataaacacaaggacgtatgatgtaatcacttggaggtgattctatatggtagaatacaaaaatgtaatggtcggggttgatggttcaaagcaatcccaagcggcttttgaaaaggggttgcacgtggcaaaggaaaacggcgccaccttgcacttggtgagcgtaattaacggggaacagtacccgagcggctcaaccttaggctacggcttcgtggaccgcggcctttacgacgacgctaccaagaagatgacggacgttttaaccaagatgaaagaagaagcggttgcggcgggcgtaacggatgtgcacacggacgtgatgatcggtaacgccaaggtggaactgaccgagtcctacccaaaggacaaccacatcgacctgatcgtgatcggggcttctgggctcaacgtgatcgggcggatgattgtcggctcgacggcggcctacgtggtacgccaggccccgtgcgacgtcacggtggtcaagaccgacagtgaaaataagccgattagcgttaagcgggcctcttatccggaaatgtaagtgctaaagaccgcaccctccctcaaactttaagggcggtgcggtctttttttctctcaattttcacagttaacctgttataattaaccttactaacagatcgcttgataagaatgaggacctacatggaaaagacccagaagttaatttggagggcgctggccgccgtggcagtgattggtggcttgggcgctagcggctactaccaccactcccactttaacaagaacgtgaccatcaacggggtgaaggtcggtggcctgaccagtgaagcagcttaccaaaagctcgcctcccaaaaacgtagcaacgacgtttacctgaacggtaaaaaaatctacgagggaaccagcacctcgtctggctacaccagcgccgacaaggccaaggtaaccaaggtcttaaaggaacaggccaccatcttgccgtcagcgaaaaagactaactacaagttgaccccgtcggagttggataccagccaactttcggccatgaagaaggcaattaaggtggcggttgataagttaaaccaaaaccgggtgatggccgtggacgccaaggcggtttggaaggataacaaggtaacggtcaccagccccaagaaagggaccgcttacgatacgtccaagattcaagccgaattgagtaaccaattggccgccgattcgatccagctgaccgcaaaggtgaagacgccattgactaaaaacagcgccgcggtcaaaaaggaagtagcggccttaaagaagctcagcaacaagaagatcacctataaggttgaaaacaagtcctacaccctgactagtgacgatatcatcaccaaggcaacctatcaaaacgggcagtaccagtttgataccgccgctcttgatcaggagattgccaagatcaacaaggcccagtcgacgctcggcaagtcctttaagtttaagacccacgccggcaacacaattacgaccagtgcccaagggtcctacggttggcggattagcacgactaaggccaccaagaccttgatggacgccctgctgaaggggacgaccagcgttagtgcgaaggccgacgtttacggaatcggctacaacaccggtggggtcggctacgggaccaccagtaacaacggcatcggtgatacctacgccgaagtttcgatctcagcccaaacggcctggttctacaaggatggtaagctggtctacagtgcaagggtggtaactggtaagcaatccagtggcgatgatacgccaaccggggtttactacatcatgtacaagcagcgcaatacgaccctacgcgggattggcgataccgggaaggcttacgcctcgccagtttcttactgggcaccgtttaccgaatccggctgtggtttccacgatgcttcctggcggaccgactggtcgacaaccgcctacgtcaacaacgggtccaacgggtgtgtcaacatgcacacttatgacgccccaaacgccttcaatgacttgtcggttgacgaaccggtggtaatttactagtttaatgaaaaaacgctcggcaaaaatggccgggcgtttttcgttaacctccccaattcttgcgtatttaagggtgaaggagggattttgatgaagaagttgatgacagtcaccaccctgatcgcagccctagcgttgccaatgacggctaaggcggcgactaatcaagggtggacacaagaagaacaggcccgttacctagcgggagtcaagttggccggggaggatttactgaccggtgagcaccaccagccaaccgatccggtggaattagccggttaccaggagggattaacgagaggccagcagtggcttgccgaccacccggttagtgaggcgccggccgctagttcaaccgctacgtcacaagtaacgagcgcagcgtcaagtacggaaccaacggaagcgaccagcgcaccaagtgatagcggggatgaacaggcagcaccggcggaatcgctcagcaacgggagcgcagtggctagccaagccgaggcaacggtcaccccggcagccgattaccacgaacgctacgctcccttgcccccgacaatcagccagcgtcaattcattaaccaggtggcaccggccgccgtcaaaatcggtcaggaatacgatctctacccgtcggtgatgattgcccaagcggccctggaatctaactggggcaacagtgacctgagccggttacaccataacctctttggtatcaagggaaccggggtggtaatgccgaccacggaaaacctgggcggtcaagacgtgacgattacggccggctttaagagctacgccgacgtcagcgctagctttgccgactacgctaaggtgctaaaccaggggctttaccggggtgtccaccggtcaactactaacagctaccgccaggcgacggctgctttaaccgggacctacgcgaccgaccctaattaccaggccaagctcaaccaactgattgaggcttaccaacttgaccagtatgaccaacagggggcgtcgccaacgtcaaccagccaagcacaagcagctgaagtcacgacggcgcccctaagctccgccgccaccagttcagttgcagcttcaccggccaacaccaaggaaaccgccagtccggtaaaggctggcggggtcccgtggccggtgccagtggccggtggtgccggttcggtggggttgctcgcctggttgcggaaattagtgaccaaataaaaagtcgttgggcgaaaaagatcgctcaacgacttttgtttaagctttgaatgttaggaaggtgccgtgccctgccaatggttggtccgcacttctaatttatcgaatttattttaagcggtcatcaatcattgccagaacggtggccacgttttgttcgtcctctaagttgtacttatcaaggtcgatcttcatcttcggcgaggcatcgtaatcttggtaccattgcttgtaggccgaccacatcttgtagtagtaatcctttaactcggggttggcgtcgatttgttcgtaatcgcggccccgttttttgatccggtagaggatcgtgtcaaagttggtttccgaataaaccatcaggtccggcgccttcttgggcagccgttcgaggtcgttcatcatgttatcgagcaaggagaggtaaacccccagttcggtatcggtgatgtttccctcggcgttgttttcccgggtgaagagggcgtcttcgtaaattgagcggtccaagacgttgttgtcgtcggacagggcctgcttgatcatggaaaagcgcttgtttaaaaagtagatttgcaacaagaaaccgtactgcttaggatccttgtagtagagggggaggacgggattttcccccacgggttcaaaaaaggccttcgtgtttaagtgttcggcaattttggcggtgagggtggtcttgccaaccccgatcattcctgctgtgataatcaccatgatgactcccctttaaaattttttcgtaacgaaacaattctactacaaaagctcgggcttgcccatcattaaataattgaggataatgaaattaacgggcaacccctttgcccagaagggaacaagaaaatggaactaatgacacaagaacaaatccgggcgcaactagccgtcagcaaacaacaggggagtttggtggaggtccacgattttgacgaggctggcgagacctttgacgtcggctttgtgttggccgtcgacgaattgtttgtcctcttactcgggatcgattgggacggtaagatcaacggtttaacggcggtccggctggcctccattcaccgggtccggagccaaactgattatttaacgaccgtttcgctcaagtgcaaggtcgcccaggaaaatggttactttgacctgtggcacctacaagatttcttgcacgatcacgattaccagggaaaaaacatcttgcgcaccctgctaactgactcctatcaaaatgacttgccgctggtgattggaaccaaaaagtacaaggggggcgacgattttaccggggtgattagcgacctggggacgattaagctaaccctccactacttcaactcccacgacttatcttctttatgggagtacgaaatcttgctggcccagatcgactacgtaagggtacgcgggacgcaaaccgccaccgcccgcaaggttttggatcaggttttccaccaggaataagcaagaggaatggtcagaacactaaaaatttagtaaaatgttttattaagatcaacaacaagaaggaacagtcatggcaaataaaatcaccatccgcgacctcgccaagcaagcgggggtttcggtcaccacggtctcccagatcctaaacgggaagggccagcgctttagcgaacaaaccagggaaaaagtgctcacccttaaaaaacagctgaactacgtcccggactttaacgcccgcaacctaatcatgcgctcatcgaagacgatcggggtcttgttaccaaacattgccaaccccttcttcgccgcctttgtcaagggaatccaaaaggcaacgcgtcaggcgggctttatgccgctgatcttttcggccgaccacgaagaagaccaggaacgctactacctacagcggctggtggagcgctccgttgacggcctgatcatcgcctcggcttcggtaacgacccagacgatcgacgagattttaaagcccctccaggtaccctacctactctttgaccaaaacgacaccccggacggcgaccggattgaagtcgataacgaccaggggggctacctagttgccaagcacttggctaaggaagggcaccaaaagatcacgctgctcttccctaagaacgttaaaaatattgaggagcgccagcacggctttgtccgcgggcttgccgaagagggaatcgactttgacccggctagccaggtagtttatggcaccctcaccaagcaggggggctacgaggccaccgacgccgttttagcgaccaagccgacggcggtctttgccgcgaacgatgaaatggcgattggcctgtaccggggactggccgagcggggggtcaaggtccccgatgacatatcggtggtcggctttgacgggattgacttagaccgctacgtcaccccgcaactgacgacggtggcccagccaattgaggaactgggggaaaaggccagcgcccttttgctcagccgaattagtaacccgcaggcgccaacccagcaaattagcttacccgtcgaactagtggtgcggtcgtcaacggcagccgttaagtaaaaaaggggggcgtcaacgatggacgaaacaaggccggccctgcccaagcgggtcctgatcatggtgttactggcggtttcgattcagattccaccaatttttgaactactggttaagcagaatatgtacagtcattcctcggtggcaaccaggtggctggtcgttgacttagtggtctttgtcgccattatcgtttgggcgacccacctgttttacaagtaccgccggtggacaccaaggccccagggggtgggtagccggctcggttggttaatcgggggctacctggtgatgattgccggcgaagacgtgttggcgattttaaaccaggctatctaccaccagagccagacgaccaataaccaaacgatcgccaacctgatgggaagctcgtctttaatgatgatgttggtggccggctccgggattttactgtcgccggtggccgaggagctgatctttcggggcgtcttaatgaacctgtttttcaaagacgatgcggtttggccgccaattttgttatccggggttgtttttaccctggagcacgccagcacgacgccggtttcgtatttgatttacttctttatgggggccgtctttgcctttgtttaccgcaagaccggtcacctaagcaacgtcatcgccctccacatgttcaataacatcgtggcgatggcggtcttgctcaacgcacgataaatacaatttagaaggggctgggaaaagcgtttttcctagcctcttactgtattcccaaatgttagacagaaaacgtagtcgataaccgcaggcctacctcggaggttattgaccacctaccttaatttcttcccgggagttctcgttgattagaaaatgcggtatgatggataagcacgaagaaaacgaacaaaataaagagaaaaggtgattgaatggggcaaattcgaattaataacatggtttttcacacttataacggggtctttgccgaagaaaagcggatggggcaacgcctagaggttgacctcgatatgtcttacccgattgaaacggcggtgcaacatgacgaattgaccgaaacggtttcttacgccgacgtttacgacacgaccaaggagtttttggaaggccaccagtttaacctgatcgaaagcaccgctaatgggttattaaagactttacagacccagtacccagccctagggacaattacggtgcgaattcgcaagtatgcggtgccaattgccggcgtctttgataacattgaaattgaggtgacggggagggcgtccgatgtggactaaggcctacttgagcattggtactaacatgggggaccgcctggctaacttaaagcaagcggtgcggttgttagagcggcgcccggagatcgaggtaaccagcatttcgtcggtttacgagacggccccggtcggtggggtggtccaagcaaacttcctcaacattgccgtgggcctgtccactaacttaagcgcccgggacctgttggcctggctacacgtcattgaacaaagccttcaccggcggcgtttaatccactggggcccgcggacgatcgacttagacatcgttttgtatgggtgcacacggttaaccagccccaccctgaagattccccacctggaaatggccaaccggcgctttgtcctggtgcccctgcaagaaatcatgcctggcaaggaacaggaatattggcacctagcccaactaatcagggacaccccggaccgggagtggcttacccaacgaattaagaaagaggaagtagcagaatggatcaagaaaaattaatcaaggccaccaagatgatgattgaggcctttggtgaagaccctgaccgcgaaggcctacgggagaccccggagcgggtggcgaagatgtacgcggaaatcttttcctccctggatgctaagcgcccggaagccgtcaccaactacaaggtttttcacgtggcagacaccccggaaatggtggtggtccaagagattcccttctattcgatgtgtgaacaccacctcttgcccttcttcggcacggtcagcgttgcctacgtaccgaaaaacggccgcgtgattggcctgtccaagatcccgcgcttagttgactttgtcagccacaagccggggatgcaagagcgggtcaccaccgaactagtccaggagctgacccgcctgctagatcccgccggggtggcggtggtggtggccgcccgccacatgtgcatggaaatgcggggggtgaccaaggccggccagtttacctacaccagtcactttaccggcgcctttttagaccaacccaacctgaaacaagaattcctagaccaagtgaggggacgaccatgagtgaataccaagagattattgaccggctacccaagcaaatgctggccggcgaagacaaccgtttagaaattttgcaccaggtattagacgccctgggtcacccggagcaccaataccaaattattcacgtcgccggcaccaacggtaagggctcgaccgggtccttagtggcccggtttttgatcaccagcggctacaaggtgggccacttcaactcgccggcaatgattagcgaccgcgaacaggtcctggtcaacgggaacctgattagcaaggacgactttgtgacgacctttaaaaagattctctgcgccctacctgactacatgaccgaacaggacctaaccatctttgaatggtggacggtcgtgatgctccaatactttgccgaccaagcggttgactgggcagtgatcgagtgcgggctgggcggccaagacgacgccaccaacgtaattgacgcccccgccctggcggtaatcacccacctggccctggatcacacccaaattttggggtccaagattgaagacatcgccaaagccaaggccggcatcattaagtaccaaacccgcgccctagtggtggcgcctaaccagccagaagcggccaaggagatcctggcccaacgcgctcaggaagccgacgtaccgctagtggaagcggccagccggggccaggtcaaacttgcggacgggaccgccaaggtaaagatgggggaagaacagttcacctgcccgtgcaaccttcatggccactaccaaacggagaacctaacgacggcgctggccatagtggaacagttacggcaaggcggggtcaccattgaccagaccatgctggagaaggtcttgcaacgggtcaccttcccggggcggatggaagcaattgaccacgacccgctcgtgatcctagacggcgcccacaacccggatgcggctaagcaaatggtggcgaccatccaagaggactttgctgaccgcccggtaacgatggtgctgggctttttggccgacaaggacgttgaacggatggtgaccatgtaccagcaggttgccgaccacctgatctttaccaccccggataaccacgggcgggcgatggacagttggccgctagcaacggcaatgggtcacgaatgggcgcccgacgcccgcgaagccctggaattggctcgtgaactaacgccgaccaacggggtaattatcgtcaccggctcgttttacctaatcaaggaattagaagaggggctcaacgatgaaagtttggatcgctagccacaaccagggcaaggttgccgagctggccatgatcctttccagcagtggtattgacgccgccccggcgcccaagctagctcagccaatgcctgccgagggggtcgcgtcctacctagacaacgcccggcaaaaggcccgtttcgttagccaagccatgccgggtgagtacgtcttagccgacgactcgggactgactttagcagcttgcccgggtcaattggggatccggaccgctcgcgaactggacgaacacggcggcgaccggctacaaaccgtcctcgcgatggtggccggtcgtgaccgggaatttacgatggaaacctgggtcagcctctttcgtgacggccaggaagtggcggtgggccacggttgcttaaccggcaccttagcggccactccccagggcgacgatggccggggctttgaccgcttattaattccggcgggacaaacaaagccgctggcgctattgccaacggcggagtggttaaaagaggcgcaccgttcccgggcggtgcgggacctgatggaacaactaaaggagaagagaattgaagatttcaattaagatgccaaccaccacggacgcctttaaccaggcggtgctagcgcaactggccacggtggaagaacagcgctttttgttttggcaagtcgaccaagcacagcagggcgccgttattgaattgatcgaacgtttagacgtcccgtttgctagccaagcagacgggatcgccctgatggtcaagcaggccgccttaccagtgttggtcaagtgggctaagcaagcctggccagccgatgacgaactccaaagctccttagaggccctcactaaggaaacggcgatcttatggcgggccggtcggttcacctttaacgtcaccgcccaccccttggtttacgggatcttaaacgtgacaccggactccttttatgacggcggacgctaccaagcaaccgacgacgtcaaggcccacatcgatcagatggttaaggatggcgccgacatcattgaggttggtggccaaacgaccaagcccggtggctttgtggaagtaagtcccgacgaagaaatcaagcggatcaccccggccatcgagtacttaaaggctaactacccggcggtggcaattgccgtggatacctacaagtacccggtcatgcaagcggccgtggaactaggggtggacatcattaacgacgtcaacgcctttttggatgacgatcagaagttaaccctgctaaaagatagccaggttggcctggtgacgatgcactcgagccgggaacacgaatacgaaaacctgacggtggcgatgaagcacttcttcgaggagaacctggcgatgctagaaaaggccggtatcgaccgggagcgggttcttttggatcaggggattggctactccaaggttgccgacggggaacaagactacgccatgatgcgcaacctcgaccagttcaactatttgaagcggccgatgatcgtggcgatctcgcgcaagggctttggtaagcaactctttgatctggccaaagacgatcgcctagacgtgaccctaattgccgaaagttacatgtacctgcacggcgggcgggtgctacgggtccacgacgtcaaggagaccaagcagttagtaaagatgctcgacacgattaccagtggttactggcaactgtaattaccaaggcaagactaggatgccagccagcgttaacaattccaagcgcatcatttggtggggactgccaaagctttcctgcttgcggccgaaggtgacttcgctaaccacaaacaaaaaaataaggtacacgccccggatgatcgataaaggattaaacgccggcagggagtggagctggtcgacgatcgttaggccgactaataacaggatgattaaacgggtgatgaccaaccaggtcgtgacccgtttttcttggtgggagcgcaggccccggtaaatggtaaagatgaggccgagaaaccccagaaggttaacggcaaagtaaagtggatccatgataattccccttgaaatcggtttaccaccattgtagcattgccgcatttgaccggcgaatggggcgtgggacttgaaaaaaatcttaaaatgtgtaaaatagcctttattgcgaaaaaagttgatcagtgaggtggaaggcatgacccattacaagattggtgataaagtagcggccaaaaagtttggtcccttagaacacgatttctccggggaagtcgaaaaggtttacgataactcagtaatgattgccattaccgaatacgatccggcagatcaaagtgggatcaacgaattaaacggccgggccgtggttcggaagggcgaagccaagatcttaaaggaagtgccacggaccaaagaggacttagaagcggccgctaaggaagaagaagaagcggcggcaaaggctgctaaatcgggtaagaacacccgccggcggcggacaaagacgactaaagagtcggctagttccgaaaaaaacgaaaaaagttccaaataagtagtgacaaatcaatttaatgtggtattataaatgagtaagttaattactcattaaattatgcgggtatagttcagtggtaaaactcaaccttcccaaggttgcgtcgcgagttcgattctcgttacccgcttctcgtcatcgcttcggcggtgattttttttgcttgttattctgccggagcttggtataataaaggcattccggtccctggagtagtagtaacggcgaacgtaattagcgacccctcgttggtgaaaggaggggcgttgccgttacgaaggcgtgtcagggaccagcagttaaatcgaagtttgagtggaatgatacattcaattagagtggtaccgcgggaaatctcgtctctagtaagcatgggcttattaggggcttttttactttttaggaggaatttaggatgaacgaacgtcaacaagttgcgtctgcactgcaaaaggtgctgccaaacctcagtgtggaagatcttgaagcaaagttggaacgcccaaaggatgctaagaacggtgattacgcctttccaaccttctttttagccaaggagctccacaaggcgccgcaaatgattgctagcgaactggctgaacaaatcgaccaaagtggctttgaaaaggtggttgttgccggcccgtacattaacttcttcttggacaaggctagcgtcgggggagaaatcttggccgccgtcttggcggacccagctaactacgggagcaccgacctgggtcaccaggggcacgtgaccattgacctgtcctcgccaaacatcgccaagccaatggggatggggcacctgcgttcaaccgtgatcgggaacgccattgccaacatcttggctaaggtcaactacgtaccggtacggatcaaccaccttggtgactgggggacccagtttgggaagttgatggccgcctacgaaatgtggggggacgaagcagaggtgcaaaaggacccgatcaacaccctgcaaaagtactacgttaagatcaacaccgaagccgatgaacaccccgaatacgatgacctgggccgggaatggtttgctaagctcgaacagggcgatccggaagcccagcggctctggaagtggttccgggaagtgtccttgcaacggtttatgaagatctacaacctcttggacattgatttcgactcctttaacggggaagccttctacaacgataagatggatgaagtggtaaccctcttagaagacaagcagttacttaaggaatcccgtggggccgaaatcatcgacctggaaaagtacgacttaaacccggccatgatccgcaagagcgacggctccaccctgtacctaacccgggacttggcggccgctttattccgtaagcggatgtaccaccacgcccaatccctgtacgtggtgggggccgaacaaagcaaccactttgcccaattaaaggcggtcctgtccgaaatgggcttcacctggtcagaccaaattcaccacattccgtttggtttgatgagcttaaacgggaagaagatgtctacccggaaggggaacattatccaattggaagacgtcttaaacgactcgatcaagttggcccgccaacaaatcgaagaaaagaacccgaccctggccaacgccgaccaagtggccgaagaagtgggggttggcgccgtaatcttccacgacctgaagaacgaacggaccaactcggtggactttaagttagaagaagtggttaagttcgaaggggaaaccggtccatacgttcaatacgcccacgcccgggccgaatcgatcctccgtaaggccggccgcccatcctttgaaggcgctacgttgaccgtcgatggtcaagaagcctgggaagtagccaagaagattggtcaataccaagaaacgatcgtccgggccgctaacgaatacgacccgtccttgattgggaagtacgccctgtccttggctaagtccttcaaccaatactacgcccacacccggattctggaagaagacgaccaaaagctctcccgcttagccctcgtccaagccgtttccgacgtcctcaagtccgccttagccctcctcggcgttaaggcaccagacgaaatgtaatttagtttaatacgttgccccgtcgcgctctgcggtggggcttttttgatacggggaaaaggttgccaacttcattgctgagggatatctgccaaaccattcgggcgtcactcccgttttggtgacaggacaaatctaaaatttggcgcaatgaccgctagacggcctgcttgataggttgggtcgcactcactgtattgcgcaaatctaaacatttgtcgtgtaccttattcggtattcgagcttacatacggtttgtcgaggagattgggttgcacttccgataacgtggaaaatgaccacaggtctagtgcctaagtacgggcgaagaacggtgcgtaccgcaccaatcttcccctagcttagcccacggcctgtttgatagattgggtcgcacttccaataacgtgctccccaatcacaggcctagtggctaagtctggccacagaacaccgctggcgcgctaacctgtaccctatccttagcccacggcctgtttgatagattgggtcgcacttcctccttgacaaatggttaagatcggggctaggtttggcgccggcttgcttgcaatgttaaaatagtcccatcatgttttcgttcggaggataaatgatggaacgtcaaagaccgccacgcttaccatttaaggagcgattgaaagaaggggtcaagcaagtcggtcaccgggtttggcaactagttcgccaccagtggcaccgtttccagctgacccgctggttgatcataattgtcttgagcctctttttggtgatgagcgcctacctgacctttgtggctaaaacgtctaacgttaaggacttaaaggcccgcttggagcagccaaccctggtttacgaccataacggtaagagcgccgggagcctgtattcacaaaaggggacctacgtttccttaaataagatttcgagtaacgtttccaacgccgttttatcgacggaggaccgcaacttctaccacgaacacggtttctcggttaagggactggcccgggcggcctacctgctggtcaaaaataaggtcttgggccgggactacatttccggtgggggatcaactttgacccagcaactggtcaagaacgcctttttaacccagcagcaaaccttctcgcgtaaggccgaggaaatcttcatctcgatcgaagtggaaaatcagtactccaaaaaagatatcttgaccatgtacttgaataacgcctacttcggtcacggggtttggggagtgcaagacgccgctaagcgttactttaacgttaacgctagccagttgacggtgccacaagccgcgaccttggcggggatgctgacgtcgccggggatttacgacccggttgaccacccgaaattagccaaggaacggcgcaacctcgtcttggacctgatggtggaaaataataagctgacccaggcacaggccaatgcctacaagaaggtgccgttaaccgttgaagatgggtacagtaattccaacacctacaagtacccgtactactttgacgccgtaatttcggaggcgatcaaggattacggcctgaccgaaaaagaggttatgaataacggctacaagatttacaccaccctcgatcaggggcagcaagaagcgatgcaagatacttacgataatgacaacaacttcccgtccaccaaggctgacgggacgatcgttcagtcagcttcgattgtcgttaaccctaagaccgggggcgtgacggccgtggtcggcgggcgtgggacccacgtcttccggggctacaaccgggccacccaaatgcggcgccaaccggggtcgacgatcaagccgattgccgtctacaccccggccctcttgcacggctacttctacgattcgaccctgcaagacaagctccaatcctacgggactaacaagtacaccccgaaaaactacgacaacacctactcgggatcggtaccgatgtataaggccctgtacgaaagtctcaacgctccggcggtctggctcttaaacaagatcggggtcgacaccggctacaagatggcccaaaagtttggcctaccggtagtgaagagcgataaaaacctggcgctggcgctcgggggcttaaccaacggggtttcgccacaacaaatggcccgggcctacgccgtctttgcctcgggtggggagctgccgacgacccactacatcaccaagaccgtggacgcctcgggcaaggtcgttaagcgcaagaacaagttgacgaccaagcggatcatctctaagaaggtggccaacacgatgacctcgatgatgatcggggtcttcaagcacgggaccgggaagaacgccgccccgagtggttacacgatcgccggaaagaccgggacgaccaattccggtttgacgaatgatgacaacgaccgcgataagtggatcatcggctacacacccgacgtggtggtggtgacctgggaaggttatgacactaccactaagactaaccagctttacgacgtcgaaaataacgacatctacggcctctttaagaccgaaatgagtgggatcttgtctaacaccgccgggactaagttcaccgtccaagacgcccaaaccaaggcgcaagaggcggccaagtccgcatcgtcatcgaactcgtctggctccaacctgtggaaccgggtttccgactttgccaataacgttaaccaacaggtccaaaacgcctggagcaacatccgctcgctcttctagctagaccaggccggtcatgatacaatgaaagcaatgtcaattaggaggacacattcaaatggttgtaaacatttacgatacggcaaacgaactggaacgccaaatgcggcaaacgcaggaattcatcggcttaaaggaagcctttgatgacttaaaggccgacaaggaagcaacggacctgttcgttaagttccaagctaagcaagcggcggcccaacaaaagcaaatgcagggccaagaaatttccgaagatgaaatcaaggaaatccaagccctggctaaagacgttaccagcaaggacgtcatccaagccttgatggccaaggaacaacaagttgaccaaatgatccaacaattaaaccagatcatcactggcccgctacaagaactttacaagcaattcggcccgcaagagggctagttacggggaagtgtgaccaaccctctcgacaaaccgtacttaggcactaggtttgtggttgggagcacgttagctgtgtaacattcaagatttgaaaagaggctggggaaactttgattttcccagcctcttttaacaaggagggatcacgatggagattggtaacttaactagcggggtggcgaccgaaggggtggcactgattaaggacgcccagttaaagacgacccggaccgggaacccctttttagccctgcgctttgccgaccggaccggtgaaatcagcggtaacctttgggacgcaaccgaaaaccaggtcgcccaatttaaggccggggtggtggtggagctcgccggccaggtcgaaacctaccaggaccagttgcagtttcggatccaggagctgcgcctggctagcccagaggagggccaaccggaagactttgtgccccgggtggcggaaacggacggggaactaaaggatgacctgcggccctttttagcggccattcaccaggtcgaatgggcgacgatcgttaatcatttgtttaaaaaatacggagcgcccttctttaacttcccggcggccaaggtcaaccaccacgccctggtcggtgggttggcctttcacaccctgtcgattttgcgcctggctaaaaacgtttgcgaccagtacccggggatcaaccgggaactcctgtacgccggcgcccttttgcacgacatgggtaaggtaatcgagttgtccggcccggtagcgacccagtacaccacgaccgggaacttgttgggccacatttccatcgttgatggcgaaattgtcgcctgttgccaagaggtcggtttattgccgaccaacccccaggtggtcttgcttcgccacgtcatattggcccaccacggcctgcgtgagtacgggtcccccgttgaaccggagctaatggaagcggaggtcttacaccgcctagatgagctcgatgcggcgatcaccgaaattaacggggcgttagagcaaaccgccccgggtgaattttcgccctgccagtttgcccttggccgccggcagttctaccggctcccaaccggacaagacacgaagaaagcgtgaagaaagcctaaaagctttctaaggagcaagcacgtgctttttgagtgtgttatattagattggtgaaaaaatccaaaggatgtgagatagtttgaaatcaaagaaaatgttggcaatcatcgctgggttagccctagcattgccgttggccgcctgcggtaacaaggcggtcgccaccaccagtggtggaaagatcacggagagcgaatactactccagcatgaagcaaacctccaatgggaaacaagtgcttcagcaaatgatcctagacaaggtgttggaaaagcagtacggaagcaaggtttcgacttccgaggtgaactccgaatacaacgcctacaaaaaggagtacggctcctcattttcaaccgttttatctgaggaaggcttgaccgccaagtcctttaagcaacagattcgttctaacctgctcttaaaggccgccgtgcgcaattactccaccttctcctccagcgctttaaagaagcaatggaagaagtacgagccaaaggttcagaccgccgaaattctggtgggttcaaaggaaacggcccaaagcatcatcgacaccttaaacaacacgtcgggaagcaagcttaaggaattcaagaagctggctaagtccaagtccaccgacacgacgaccaagtctaacggtggggtcttatctgcctttgataacacggatactagcttaccatctgcttaccgtaaggccgcctttgctttgaagaccggtgaatacacgaccgaaccggttaagaccgacaacggttactacgtcatttacatgatcaagcacccggctaagggtaagtactcttctcacatcagcgacttgaaggaccaaatcgttacccaaaacctgaacaactcgaccttcttacacaacgttgtttccaaggtcttaaagaagggtgacgtttcgattaaggattctgacttaaagaacatcatggacgactacttgactagttcttcgtcaacgtcttccacgacttctagctccagttcctcgagttcttcaacctctagttctagctccagttcttctagcgctagcgaatcatcgtcatctaactaatcaatgattaacgggtgacaataaaagcccagcacagttcgcattcagcgagctggctgggctttgttattgggtaggttactgctgacgttcttgaaccgtctttaacacggcttggatcttttccacgtgcggggcgatcttggtttgaaaacggctgacttccgcttgtaggtcactcaccaccggggagaggtgggcgacttccgtttggaggcgcttggtattttgggctagctgggcggtgctggttttgagggcgagcacctgattctttagcgtcgccagcttagcgcgttggttagcaaacatgttagtcctccaggtggtcgatgatcgcttgttggatggcggtgtacttttcctcgttgtattccccggaattatcaacgaagtgaatggagaagtcgtcatccttggtgtaacgtgggatcaagtggatgtgggagtggaagaccgactggtaagcgacggccccgttgttgttgacgacgttcatcccctcgatggccgggttggaatcacgaacggcgcgggccacctttggcaggcgggtaaacacgtcttgggctagttgttcgtcgtagtcaaagaggttggcgacgtgttctttgggtactaggagggtgtggcccggcgtgttttgggaaatgtctaaaaaggcgtagaccaggtcgtcttcgtaaaccttgtagctagggatttccccggcgataatcttacaaaaaatgcaatcactcatactaaaacctcgctttaaaaaccaagttacaatgatgagtttattttaccacgaactggggtggcactggcgaagaaagggcgccactacttgttaacaagaagatagggtataatacaaacattggacagcaatgaggagggacaccatgattttagaaattgatgacttggtcggcggctactcgcgggtcccggtcttaaaaaaggtctcctttaaagttgaagagggccaactggtcggtttgatcggtttaaacggggccggcaagtcaaccacgatcaaccacgtgattggcctcttgcaccctttttccggcacgattaaggtcggtggcaagcagttaaaagacgacgccgaggggtacaaggcccagatcgcctacattcccgaaacaccgattctttacgacgagttgaccctgcgggagcacttagccctgacgatccgggcctaccaaatggatgaacaggcagcttggcaacgggcgcagcggctcttaaagatgtttcgcctggataacaagttggactggtttccggtggacttttccaaggggatgcgccagaaggtgatgatcgtggccgccttcatgaccgaagctaagctcttggtggtcgacgaacccttttacggtttggacccgctcgcggtgcacgacttgttgaacctgatccaggagaaaaaagagcagggcgtcggtattttgatgtcgacccacgtcttggataccgcccagcgttactgtgaccgcttcgtcctcttggccgacgggaaggtgaaaacccaggggaccctcgcggaactaacggcaggcgggcagaccctggatgaggtctacttgaacttagcaagggatgagcaacatgggtgatttatttgaacaacggcggcgtcgccacttcgttctcttaatgaagtactggcggctcgtcttcaacgaccacttcatcatcgccctcttctttttgtttggtgcgttggcatacacctacgcccagatgcttgcccacgttagccccggccagtggtgggcaaagctgtttttgaccctctggttaggcttgatcgttcacgttggccggttggcgaccctagttgaaccggccgacccggtctttttattgccgcaaaccagctcgatgatcaactacttccggcgggcccgttactacagcctgattggcggtgaggccatcacaattttggccaccgtggtggtgttgccgttggcgatggcgaccgttaaactgaccggctttgaggtgggggaaatcatcgcctcaatggtattattgaagtttgcccacttgatcttggcccagcgccacctctccttggtggccaatttaaccatgctcaacgtggcgggctttggcgaacccttagtggcccaagtgattacctggtgggtatcgccaacctggggctttgtagcaacgatcgtcatgagcatcggccacttcgcccacctccgggtcaccgaagacgccgattgggccaaggcgatccgctttgaacgggagcggatggaatcggtctaccgcttcttcaacctcttcaccgacgtaccgcaagtgcaaggtaaggttaagcgccgcgcttgggccaacgggttgattaactggttagccaagggcaatgcctggaccttcttgtacgcccggggcctggtgcgcaacgtcgagttatctggcttaattgcccgcttgacggccttgatgatggtggtgctcttctttgtcccactagcctggcttaacaccgccctgttggtgatcggcctgtatttgattatcacccagctgacccccctggccgaccactttgaagccaaggccttcacccacgtctaccccttcccaccaaaagagcgccaggccgcctttgttaaggtggccaccaaggtagcggtggtggtggccgttttattggcggtcgcctctttgggggtcaggttggactggcaacgagcgggaatcaacctagtcgtcgccctaattgaagggtgcttgttgacccgttactacttaaaaacacgaattcactagcgaaatgaggaactaacatgcgcgtaaagcacaaaaagtgggccgtacccctgatggaagcccaccccgaaatgatgacgatggacccggccagctttaagggccgttggcaagaacgatttgccaagccccaaccgcttcaagtagaagtggggatggggaagggccagttcattatcgggatggccaaggcccaccctgaaattaactttatcggcttagaaatcgaatcgacggtggcggcgatcgcccttaaaaacgcccttcccgagcaattaccaaacctgaccctggtccgcggcgacggggccggcttggacacctactttgaagacggcagcattgaccggctgtacttgaatttctccgatccgtggccaaagactcgccacgaaaaacggcgcctgacctacaagaccttcctggccaactaccaacaggtggttaagccggggggcggcttggagtttaagactgacaaccaggggctgtttgagtactccttaaccagccttaacaacttcgggatgatttttgacggcgtctggttaaacttgcacgaaagcccggaaaacgagggcaacgtggagaccgaatacgagcagcgttttgcgagcctcggtcaacccatctacaagcttaaggcgcacttcccggtaaactaaaaagggcagctggatttccagctacccttttttatgttgcagaaaaggtacttctcacggcctgtcgaggagattgggtcgcacttctattaacgtgctcctaaccacgagcctagtgtctaagtacgggcaaagaacggtgctggcgcatcaaccatttgccctagcttagctatacggcctgtcgaggagattgggtcgcacttcttcttaattcatcctcttcaactcaatgattgaaccggtgtaagcgtcggctaaaaattcgtagttgaccaattggtcgtcttcttggcgccgcaagccaccgcggtaagccgtggtcttataagcaaagcgttggaagggaatcggttggtagtcaatccaagagccggccagggggccttcttttttaaagtcgttggtgacgagcttgagaatggttttagccccacggcgacggtcaccaaacatcttgccagtgacaaagcctgccaacgccgctcccccgagggttagcggaatcatccaggggtttaaggaaccatttaaattatccataagcaggtcgcttcctttgctagatcggcaatgccttgatctgagattaatcgactatattgtaccatactgacccggtggtgcaattgattgccccacggctcaattacttggcaggtggcgggggctatgctatgataccgataaatagtaagtgaaagtaggaggtttcaaaatggaaactttaccaaagacggacctggccgggttaaatgaccgcgtcaaggacggtaagcacgtgctcttttttacggccggttggtgcccagactgcgcctttattaagccagcaatgccggaaattgaacgcgactttgccgattaccaattcattaaggtcgaccgggacgaaaacatcgatttagccgccgacctgggcatcatgggcatcccgtccttcgttgcctacaaggatgggcaagaaattggccgcttcgtcaacaaggaccgcaagaccaaggaacaggtggaaagcttcttacgcagtttataagctaatgaaaatcccgtcgcccttagtggtggcgggttttataattatctgcccgccggcgggggaatatggtacacttaggtttggtttatttagaaaaatgaatggagatgtgagtcttacatgctaattgcaagttacaatcgtcccggcatgggcgacgtattggtgacgatggtcaacaacggcagtggggagcaaacggttaccaccaagcaaaacgtgaccgagattaaggacgcccagggtcagcttttgggctacaacttccaaaacgccagccaactgctgccggatttggaaggacaccgggggcaagtagtcctaactgaagaccaggtggccactttgaaccaggcgattcaagaagccggctttgcaaccccgttggtggccgacctcagccctaagtttgtggttggttacgtcagtgaaatggaagaccaccccaagtccgatcacttgcacatcaccaaggtggacctgggggacgaaacggtgcagatcgtctgcgggtcacccaacattgaaaaccacgttaaggtgattgtagcgaaggtcggcgccatgatgccatccgggcagattatttggccgggggaactggtcggcgttgaatccgacgggatgatttgtgctgggcgcgagttgaacctgaagaacgccccggacaagccggggtgcgtcattttaccagctgactttggtcaaccgggtgacgcctttgacttcgagaagggtaaccaactgttttaacgagcggacggcacgagaggaagcaatcatggaaaaaaagacttactactttgtcggaattaaggggaccgggatggccgccttggcccgtctcttaaaggacctggggaatgaggttttgggctcggatatcgaaaaagaaacctttacccaacaaccactagcagacgccggaatcccggtgctctcctttgacccggccaacctaaaggaaggcatgatcgtggtccaggggaacgcctttagtgatgaccacgaagaaattgtgcgggcaaaggaaatgggcctcaagatccaatcttacccggaaacggtggaacaagtggtcgctaaccacacctcgattggggtggccggtgcacacggtaagaccagcacgaccgggttattagcccacgttttatccaacgtcgaacagacctcctacttgatcggtgacggggtcggtgtcggggtggcggacgcccgcttcttcgtctttgaagccgacgaataccgggaccacttcctggcttaccacccggactacgcgatcatgaccaacgttgacttcgaccacccggactacttcaaggacttggccgacgtcaaggattcctttgaaacctacggccggcaagtcaaaaagggtctctttgcctggggtgaggataagagcctgcgtgacttaaacgttgacgtgcccgtttactactacggaacggcacccgatgatgacttccgggcggccaacatcgtccggaccccggatggctccacttatgacgcttactacaaagatcaaaagctggggacctttaccatccacttgtacggggaacactccgtcttgaattcgttggccgtggtggccgtggcctacatggaaaagatcgacttggaaaagatcaaggccgaattggccaacttcagcggggtgaagcggcggtttgccgaagaagacatcgccgatatgaaggtgattgacgattacgcccaccacccgtcggaaatcaaggcgaccattgacgccgcccgccaaaagttcccacaaaaggaactagtggtggtcttccaaccccacacctactcacggctagccgcttacctgacggaatttggccagagtttaagccgggctgacaaggtctttgtgacgccgatctttggctcgattcgtgaacaaaacgggtcggtttcggccaaggacctcgaggacctgatcccgggtagcgaggacatcgatcaagcatcgattaccaagctgttggcataccacgacgccgtggtggtcttcatgggggccggtgacatcgaaaagtacgaggatgattacaaggcccgtttgaaagagcgggggtaaattagttgaagggaatggtggcatttgctaccattcttttagttagtaaaactcttttagttagtaaaacagaaaatttaatgggaggtcatatcgtggacaacttttcacgtgagcccgaacggcgtgaagtaaacgtcagcgggctaaatacctttttgacccggatgtacgggttgatgtctttagcagtcttcgtctcggccattacggcctacctgaccatgaccgtcttcaaagcggcggtcttcacctttgttgctgggcatgccggcttggtctggatcattttgctcttgccaatcgccctttcgatggggattagctttagcgccaccaggaatccggtcggttcctttatcatgttgatgttggtgtcgatcatctacggggttgagttctccttgatctcggcaatgtacacggcggccaacattgcggcggccttcgtttcgtcggccgtgatcttcgtgacgatggcggtctttgggacggtcaccaatcgcgacctcagtaaggccggtagccacgccatggcggcgttggtggccttgatcatcgcttctttaatcaacatgttcttgcactcagcagcgattacctacatcttctcctacatcgccgtgatcatcttcgtggtcttaacggcttgggatgcccagaagatgaaggccatctacgttaactacggggctgaagtttccatgggcggcttggccgtcatgggggccttacagctttacctcgacttcattaacttattcttacagctcttgcaaatctttgggatgagcaaccgcgactaacaaaaaagaaccgtgccaaaagcgcggttcttttttgttagtttaagaaatcggccactaattgaagggtggtttcccgttggtcgccgtcgccacgtaactggtggctggccccctccaggaagtggatcaccccgttttggtacataacgttgtacttttgtgaggccttggggtcgaccaccgtgtcggccaggccgtggatcatcaaaaccgggccggcgtagtgctgggcggtttcgtaaattggcagcagttgggcggtcctgaagtagtcgccgccgactttgaagccaccaaccgttacgtagtcgggaatgtggttgggatcgtaggtggttccttggcaagtcccgatcagggcgtcatctttgagggtggcagctggggccaagagaactaacttgtcaatcacgtcgcggtagtaggcggcgagcatcgaagccaccaccccgccttgtgagtggccaaccaggatgatttcctttgcctgaacctcctggcgggcgtagtcgatgatcttcatgccgtcttgaagttcgcttaacacggtcatgtcgctaaactgaccgtcggacttaccgcaaccggcaaagtcaaaccgtaacgtggccaggccctggtcgtttaagcggtgggccagttggtttaagaggttctcctcggtgtaacctaggtcacccttaaaaccgtgcattaaaatggcgatccggtcgtttggcacctggtcgctcccctcgagcagcccccgtaaggtaagaccggcactcttgattgcaacttccattgtatcaactcactttcatgtttatccttacgatacccgggtcaaaaggcgatggcaagcgctttatttaagggggcggacaagcggcggggcgcaaagtttgctacaatgggagcagtgactaagaagggacggataaaaatggctaagcagcttttattaatcgacgggaatagcatcgtcttccgggcgtttttcgccatgcacaaccagatggagaagtttaccaaccaggcggggttacacacggcggccatctacgggttcaaactgatgctggatcacatattaaaggaggttcaaccagacgccgccttggtggcctttgacgccggcaagaccacctttcggaccgaaaagtacgccgattacaaggggagccgtgataaaacgccgggtgagctagtggaacaactgccctacgtacgcaagctggtcgaagcaagtggcctccacgcttacgaactagttaattacgaggccgatgacatcattgggaccctggccaaggaaggggaccaggccggctttgagacgatgattgtgaccggggaccgtgatttgacccagctggccaccgaccacactaccgtggccgttaccaagcgcggggtgacccaaaccgaggagttcaccccggcatacatgcaagaaaagctgggcgtcaccccacgccaatacatcgatgtgaaggccctgatgggggatagctccgataactaccccggggttaccaagattggtgaaaaaacggcggtctccctgattcaggaatacggctctttggacgggttgtacgaaaacatcgccgcgatgaaaaagtccaagcgcaaggaaaacctgatcaacgaagaaaagattgctcgggagtgccaagacctagcgacgatccgccgggacgctccgctggcaatcggcttaaaagacatcgcctaccagggaccggacgaagccgccctaattgacctgtaccaagaattagacttcaagtcctttttaaaggagctaggcgcccaagaagggggcgcacaagttgaccaagcgccaatcgaataccaggtgttagacgaagacaacatggcgttggttgatcaactcggggctaccgtttgctttcaattagaaatgccggacgctaactaccacgaatcaccactggccggctttgtaattggcgatggcaagcggtggctagtcagccgtaacgtcgacctattaaccaccgccccgctaaagaagctactcgaagacccagcggttgaaaaggacgtcttcaacgccaaggcccagctggtcggcttacaccggttaggggttgacctggccggggtcgactttgacttgctcttggcttcttacctgctcaacacgagtgaaaacgccaatgacttaggggtgctggcggccgcccacgattaccaccaggtccaaactgatgaagaggtttacgggaagggtgctaagcgggccattccggctgacgacgaggtctttttcacccacctagccaaaaaggcccgggcgattagggaccttaaagaacccctataccaacagctgaccgataacgagcaactaccgctctacgaagacattgaacgccccttgtccgcggtcttggcccacatggaaatcaccgggattcatgtcgacgcagcgaccctaaaggagatgggctccaagttagttgaacgtgaggcggagctagaacaggcaatttaccaagaagccggcgaggagtttaacattaactccccgaagcagctgggcgtaatcttatttgaaaagatgaagctaccggtcatcaaaaagaccaagaccggctactcgacggccgtcgacgtcttagaaaagctggccgaccgggcaccgatcgtccaagacatcttggcctaccggcaaatcagcaagctgcaatcaacttacatcaccggcttactcaaggtgatccaccaagacgaccaaaagatccacacccgctacttgcagaccctaacggcgaccggccgtctctcatcagtcgacccgaacctgcaaaacattccggttcgcctggaagaagggcgccaaatccggcgggcctttaccccctcggcaccggggtggaagatcttttcgtcggactactcgcaggttgaactgcgggttttggcccacgtcaccggcgataagaacatgcaggctgatttcttggcgggcaaggacatccacgccgccacggccaagcggatcttccacttgcaaagcgaagacgaagtgacccccaacatgcgccggcaggccaaggcggtcaacttcgggattgtgtacgggatttccgattacggcctagcccaaaacatccacgtctcccgcccacaggcccacgaattcatccagagttacttcaaggaattcccgggggtggaaaagtacgttcacgacatcgtggaactggctaaacagcagggctacgtcgaaaccctgacccaccggcgccgttacctgccggaaattcacgcgaagtcctttacccagcgttcctttgccgaacgaatggccatgaacaccccgattcaggggtcggctgccgacatcatcaagattgccatgatccgaatggaaaaggccttaaaggagcggggcttacgggcccggatgctcttgcagatccatgacgaactggtctttgaagcgccggaagaagaaatcgccaccttagaggagctggttccttccattatggactcggccgtaaagctagacgtaccactgaaggtggaaagcaagtccggggcaacctggtacgacctgaaaaaataagctagggcggtgggcaaattacttgccagtccgccttttttattgataatttagagtgattataaacaaaaaggggagttaagtatgccagaaatgccagaagttgaaaccgtgcggcgggggttaatgcgaatcgcggccggccgtcagatcaaggggattgacgtcaattacgggaagacgattgaaaatgacgtcgaggagtttcgccaggccttgatcggccaaaccatcgaacgaatcgaccgccgggggaagtacttgctcttccgcttttccaacgacctgacgatggtctcccacctacggatggaggggagttactttaaccaaccgaccggcgccgaagttgataagcacacccacgtgatttttcacttaaccgacggcaccgacctgtgctaccgcgacacccgtaagtttgggcggatgcacctggttaaaaccggggaagaaatgacggtcggcgggctgaaaacgatcggcccggaaccaactgaagaggactttcagtttgattacttcaagcagatcctcaagaagagccggagcaagattaagcccttcttgttggatcagtcccacgtggccgggttaggtaacatctacgctgacgaagtcctttggcaaacccaaattaaccccgagcaaccggctaattcgctgactgacgatcaaattaagcgcctgcgcgaaaacatcatcgcagaaatcgcccgggccacggcgggccacgggacgaccgtccacacctttaaaaacgccttcggggacgctggtcaattccaaaatgaactccaggcttacgggcacagcggtgacgcttgcccgcgctgcggcaccaagctagtcaaaattaaggtggcccagcgggggacgactttttgtccgcactgccaagcgctggtggaaccagatgactaaggtaattggtttaaccggcgggattgccagcggcaaatcgaccgtggcggcccagttgcgccaagccggcctggtggtccttgatgccgaccaagtcgcccgggcggtggtccaaaaagacagtcccggcctgctagcgctgacccgggccttcggacgtcaaattttaaagccggatgggagcctaaaccgggccaaactagggcaactggtctttagtgacccggcggccaggaaacaagttgacgccattacccaccccttgattcgccaagtttttgaagcaagcctagccgcgttgaaacgactaggggtgccgctagttgtcttagacgttcccttgttgctggaagccggctaccaacgctattgcgatcaggtggtggtcgtcaaggttgacccgcttacccaactgcaccgtttgatggcccgtaaccactacggtagccaagaagccagggaacgaatcgccacccaaatgccgttagcggaaaaattggcccacgccgacgtggtaattgataacaacgggagcagggaaaagactgcccgtcaggtggctaagttgattgctagctggcgggaaggggccgatttgcactctgtggtataatatagtttacgaaactatttgtcaggaaatcaggaggaacttcgatgctttgtccacactgtcatcataatggatcacgcgtgatcgacagtcgccccgctgaagatgggatgtccatccggcggcggcgcgaatgcgtcaactgtggcttccgctttaccacctttgaacgatacgaggaaacaccgttactcgtggtcaaaaaggatggaacccgggaagaatttaaccgccaaaagatcttaaacgggctcgtgcgctcggcggaaaagcggccggtcagcatggataagctaaccaagattgccgatcacgtcgaagcccgggtccggcgccttggtgaaaacgaggtctccagtcaggtcatcggtgagtttgtcatgaacgaacttaaaccggtcgacgaaattgcctacatccgcttcgccagtgtctaccgccagtttaaagacgtcgatgccttctttaaggaaattgaatcgatgaaaaaggaggagcgttgatgggtaccaccccatttaagctacaaccgcaaaccggctacctcgtcgccgccagtccggattatgccggcatagttcaagagtggttggtggattactaccaaccactacttagccccacggcgcttagcttattgttggcacttagcgggcggttggtccccaacccgatgccagcggagcgccaccagcacaccgtcctgttggaccaattaggggtggggattaatcaaattgaccaggcccgcggccaactggaggccctggggttgttgcggaccttctttcgggtcgatcagctgggcccggtagtgatctaccagctacaggccttaaagagccccgcggaattcattaacgaggacctgtttgccgtcgttcttttacaacacgtgggggaacggcgctaccagcagttggtggacaaggctaaccgttaccacctggctaccgatgactatcacgagttaacccagggcttttttgaggtcttcaagccgctggcgtccccggcggaccagcacaccgtggcggcaagcaaggaccagttgggccagccgagcgaaccacgggtaacggcccctgaaccaagcgttgactggcaattcttggccaaccaggttcaggcccagggattagctagcgaccaactatcaaagcaccgccagttgatcattgccgaaaagcgggtttacggtttgacggagctggagttggccaccctactgttggcggccaccgatttaaccacgggcgaactaaactccgaacagtttaaggcggtggtggccaaccgggcggcaccaaaggaaacagtgccggttaaaccagccccccaaccggccgacaaaacggggacactgacgccccaggaaaaggccctcgtgctagaagccgatcagggcgccccactccagtacctaacgaacctcaagaaggcgactggttcgggctttgttaccccgaccgagcggcggaccttagaacggctagttagccagacgccgttaaccgacggggcgattaacgtcttgagttactacgttgtggttgagcaaggcaacgccaatttagcgcctaacttcgtcaacacgattgccaataactggacccgccagggcgtgcggacggccgccgatgcggtagcggcgatccaaaagttttggcaaaaaaccagcgaaccaaagcggccgacctccaaaaagggccggcgtaaaacaattgtcgaacagctccccgcttgggcgcaggatgactcaaaacaaccggcccaagtggcgtcgccagaacaaattcaagcggccaaagaggccctggctaaactccgggccagcgaaaacaaaccgcaccacaatcaatgaccccgagtggtcaacggaaaggatggatggccatgcaatcaatcaaccaggcggttagcgccgctttaaaggcccgcgataataaccaggcctaccagcaactcgtcgaccacgtcttaaacgacccggaagtccaccagtttctggcgcaaaacgcgaactccctaacggtcgaaaccattgagcgcggctactcaaaactgtacgaattctaccgggaacgggagttaatgcgcgccggccgggcaacggtcgccccggggtatgcgccccacctcgaactggccaacgggcaaatcgccgtgacctacgttccgaccgcccagttaaacgcacaacgcgaacaagaggcccgccttaaccgggtccaagccatcaacatgcccaagttcatccgccaggcctcgtttgataccttttacatggaacccgaacggacctcgcctagtcgccagcaggccttcatggcggtgacggactttatgaaccgttacttggccaaccaaggctttgttccaggcctctacttttccggcagctttggcgtgggcaagaccttcttgctcggcgccttagcaaacgaactggccggccgcggggttgagtcaaccttagttcacttccccaccttcgcggtgcagatgaagggggcgatcgccaataacaccctcgaccaaaagcgcgaccgggttaaggcggccccaattttaatgctcgatgatatcggcgccgatgctttatcgacctggctacgcgacgatatcttgggggttatcttggagtaccggatgcaagaggagctaccgacctttttctcttccaacttcaccatggctgagttagaggcccacctggcggtcgatacccaagggaaccaggagcccctaaaggctaagcggattatggaacggattcgctttttggcccgagaagtcccggtcagcggccgtaacctccgtcaagaacaaagggcttgacttcgggcgggggatttagtatattagtaaacgttgaaagaaaaagtagaagcacccgcttctcgcctaggtgattggagtcgccgggctgacgagattaaatccgaatgaccattagggttagttcgctttgcgggggtgtgtgtgcactcccgttttttcttgcttaattttctttcgctaatcaaattggaggtgtgttgccatagctcaaggaatgattgtcaataacggtattcgtgcgcgggaagttcgcctgatcgaccagaacggggaacaacttggtattaagtccaagcgtgaagcattgcaacttgcagaggatgccggccttgacctggtgcttgttgcacccaaggctcgcccagcggttgcgcggatcatggattacgggaagtaccgttttgagatgcaaaaaaaggaacgggaagcccgcaagaaccaaaagacggttgccgtcaaggaaattcgcttaagccccacgatcgacaccaacgactttaacgttaagttaggtcgggtacggaagttcatcgaaaagggtgatcaagtgcgcgtttccctacggttccgtggccgggccattacccacaaggatatcggtcgggatatgattgaacggatggcggaggaaaccaaagacatcgccacggttgtgcaacggccaaagatggaagggcggagcatgttcttaacgcttgccccgcttgataaagcaaaaaaataaattaagaaggtaggaattcgttatgccaaagatgaagactaagagcgctgcagccaagcgtttcaagcggaccgctaagggtggtttcaagagtggtaactcatttacttctcaccgtttccacggtaagaccaagaagcaacgccgtcaattgcgtggtctttccatgatggacaagtctaacgtaaagcgttacaagaagatgattcctgctaagtaattgcgggacgcacagcgaaaactatttaaatttgtaggaggataccactatgcgagttaagggtggaacagttacgcgcgctcgtcggaagcgcattatgaagttagcaaagggttacactggttctaagcaccgtttattcaagacggccaaggaccaagtgatgaagagttacacttacgctttccgtgaccggaaggtgaacaagcgtaacttccgtgaactctggattgcccggatcaacgccggtgcccggatgaacggtctgagctactccaagctgatgcacggcctgaagttggctaacatcgacatcaaccgtaagatgcttgctgacttggcagttaacgacgccgacgctttcaaggccgtggttgacgaagctaagaaggccctgaactaattcaattagtcgggatataaattaggcaaaggccgctctggggcggttcttgcttttaacaattggcctccagtaatgttcgtttcgaactgctgggggccattgttgtttaccacctaactacgattggaggcaacgtcatcaaagagcaatccccaatctataaccgtgaccacttataccagtaccgttggttagcgctcgccttcaccttttgcgggggctacattgatgcttacacctatggcttgcgcggcaacacgctagcggccggtcagactggtaacatcatttttttcagtgttgaattagcgcaacacaacttaccaggcctggtgaccaagttgtggacctttgtggcctttatcttaggactggtgaccgttgcctacttccgggttcaccaccgaacccattagtggcgcattgtcagcttactgccggtaattttaatctgtttggtgatcggtttgatccccaccacctggtccaataacctggtggtgccaccgctagcctttgggatggcgatgttaaacctagcctttgataagattgaagggctggggtataacaacgttttttcgaccgggaacctaaaaaaggcggtgaccggttggtgtgcgtacttcttggaaggggatcgacagggcctaacggcggcggttaactacaccggtttagtgagcgcctttatcctgggggccttattgtcggcagtcttacaacgggtttgggggacgacgacgatttggggagcgtcggtcctgttgacgatcgtcagcggtttgtacgcgttcttgttgtaccggcgtagtcagtacactaagtcgcccttttaccggtcgggccaagatgatggtcacttagattgaagccccaggcgacaattactataatggtggtaatgactaaacacacaaggagaaaattgtgctagagaaattcaaaccaacgtggatggtgaactcgatttatcacgttcgtccggcggaactgaaggaagccgggattcgggccgtgttttccgacctggataacaccctgattgcgtggaataacccgaacggaaccaaggaactaaaggactggatgacgtccttaaaggaagcggggattcctttgattgtgatttccaataacagccaccgccgggtggagcgggccgtgtcacccctgaacctgcccttcgtttcccgggccctcaaaccactttcgtttggcattacccgggccaggacgcgcctgggccttgaagccagcgaggtggtaatggtgggtgaccagttgttgaccgatatcgccgccgctaacgttgccggcgtccgtagcatattggtccggccactactcgacagtgaccagtggaataccaaactcaaccgcttgatggaaaagggggtcaaaaagggcctcttaaagaagtaccccgaacaaacctggcaggagggattgaatgacggaattaaatagggacgaagaactgcgctgcatcggctgcggggcggtaattcaaaccgaagacaaggacgccttgggctacacgccggcgtcggcactgaacaaagggctggaaaccggtgagttatactgccagcggtgtttccgcttgcgccactataatgagatcgccccggtttccttgacggacgacgattttttgcgcttacttagccacatccgcgaggccaacgccctgatcgtttacgtggtggatatcttcgacttcaacggctcgatcatcccgggcctgcaccgcttcgtcggcaagaacccggtccttttggtcgggaacaaagaggacttgttgccgcggtcgctgcgccgctctaagctaaccgactggctgcgtcaacaggccaaccaagccgggattcggcctctgatgacaaccttggtttcggccaaaaagaatcaccaggtcgaagaattactggccacgattgagaagtaccgccagggtcgcgacgtgtacgtggttggggtgaccaacgtggggaagtcgaccttgatcaaccagatcattaagcaacggaccggggtggaagacctaatcaccacctcgcgcttcccagggacgaccctcgataagatcgaaattccgctggatgacggtcacgaactggtcgacaccccggggatcatccaccaagagcaaatggcccacgtcttgccggctgaggacctacggctggtggcaccccaaaaggaaatcaagcccaagacctaccagctggatgagcagcagacgattttcttgggggggattgcccgttttgactatctgaaggggccgcgggctggtctaaccgcctactttgacaacaacctccccctgcaccgaaccaagctggccaatgccgatgccttttatgaaaagcatttgggcggcctcttagttccgccacatcaaaacgaaattgatcagttcccgccgttggaacggtttgaatttgcgattacggaaaagtcggacctggtctttgaagggcttggctggatcaccgtcccagcggggctggtggttgctggttgggcaccgaagggcgtcggcgtcttagtacggcgggccatgatatagaaagtgaggaagaattaaatgaatttacgcggaaagcaaaagcgctttttaagggcgcaagccaatcacctacaaccgctctttgcggtcgggaaaaacggcttgacgccggcctgggttgaccaattaaccggcgccttagataagcgggagttaatgaaggtgaatatcttacaaaacagtgacgccacggcccaagaggtcaaggactacatcgaacaaaacagtgagattcaagtggtacaagtaatcggtcgggtcctggtgctatttaaggtggccgaaaacccccgtttccaagacctctcagtgcgggtggctaaaatctagattgcggggtgaaatgtggtgcaagcagtggtaaacgttatcccaaaggttcaaccccaacaggttaaagcggaaaggcaccgccgggtcggtttgtacggcggaacctttaatcccgttcacaacgcccatttattggtcgccgagcaagtcgggcggaccctgtccttagataaggtctccttcttgccggacatgcaaccgccacatcgcgatcacaagggcacgatcgccgccgatctacgggtggatatgctgaagttggccgttgccgataaccccttttttgacatcgaaatggaagaaattaaccgcgggggcgtttcctacacttacgatacgatcaaggccttaaaggagcgtcacccggataccgattactacttcattatcggtggtgacatggtcgactacctgccaacctggaacaagatcgatcaactggtggagatggttaacttcgtgggggtccggcgcaagggggccaaaaacgaggcccagtacccggttatctgggtcgacgtgccgacggtcgccatctcgtcatcggacatccgggcccgggtgaagtctggccagtcgattcgttacatggtgccacgcgccgtcgaggattacattaaggagcatcagttatacgttgactaacgaattagagtatcaccaacagttactgccgctgagtcgtgccgaattggtggataagcttcgccacgccatgaaaaagaagcggtttgaccacgtcttgcgggtcgaagaaacggccatcgaattggccaaggaaaatggggtcgacctggaactagctagcatcgccgctttgtgccacgattacgctaagcaacgccccgaccaagacttcattgcaacgattaaggaaaagcaccttgatcccgtactcttaaactacggcaacgccatttggcacggggtagtgggagccgagctggtggccgatgaactggggtgccacgaccaacggattttagacgccgttcgtcagcacacggtcggggcgccgtacatgaccaagctagcccagatcgtttacatggccgactacattgagccggggcgtgattttgagggggttgaactggctcgccaggtcacccaccaaagtctggccaagggagtcgccttgcaaaccaaacaaaccctgatgtacttagtatcaacgggcaagcccgtttatccaactactctggcgacctacaacgcgtgggtgccaagcaacggaaaggaagattaaatgcaaagcaaagagttattagaaatggtcgttaaggccgcggacggtcggcgggccgaagacatcgtcgccctaaaggtggaccaaatcagcctgatggccgactacttcgtgatcatgaccgggagctccaatcgtcaagtgcaggcaatcgccaacgccattgtcgaaaaggcccacgagcaacacgttgaaatcggctccgtcgaagggaaggaagcggcccagtggatcctggtcgacctgggggacgtggtcgttcacatcttccgcgaagaaacccgcgaattttacaacttggaaaagctgtgggccgaagcgccactggtgaacctgagtgcctgggttgaagccaaatgatttaccagaccttcgcccaactatatgacgaactatttgacgaccagctctacgctgattggcagtcgtttgtgatgcgagaggtgcaagcgccggggaccttgttagacctagcggggggcgccggtcgcctggccgttcgcctggccaagcagggtttttccgtcaccgatgccgatttgagtgtggagatgctgtcattggccgaccagcacgcccaaagtgctcaggttgacctggccctggtggaggccgacatgttggacctaaccggcttgggccagtttcagaccattacttgctttgccgactccctgtgctacttaaatgacctagcgcaggtgaacgcggccctgacgcaggccggccagcacttggcaccgggcggaaagttcttgtttgacgtgattaccccctaccaaaccgatcaggtttacccgggttactcctttaattaccaagacgaggatcacacccgggccttcatgtggcaaagctttgccgacgaagaggtggctcacggcgtcattcacgacttgaccttcttcattcaacagggcgacggcagctaccggcgcctgagtgaaacccactttgagcggacctacccgctggccgactacctgacggccctaaaggtggctggcttcgaccaggtccaagtcagcgccgactttggccgccacgaggttaaggatgacacgacgcggtggtttttcgtctgccaaaagggggggaccattaaatgaaggccgtgggacttgttgttgagtataacccgtttcataacggacaccgttaccacctagcccaggccaagcgcctgactggggcggacgtggtggtggccgtcatgtcgggggacttcacccagcgcggggagccgaccattttagataagtggtcccggacactggccgccttacaaaacggggtcgacctagtggtggagctaccggttgccgacgccgttcagccggcccaccgctttgccatgggggccttatcgttactaaacgatttacaagttgccgacgtggtgtttggtgccgagcacccggactgggactttgcggcgatggtaaaagccgagcaagactttaaccaggccgccttccaccagttcaacaatacctacgccacccagtttaatcagcaactggaagcggtgactggccatgccctaaccgatcccaacgatatcttggcctttgcctaccaccgggctaaggccgccggggactttggctttcacttacagccgatccagcgcgttgataaccattacgccgatcagcagttgaccggggcgatctcatcggctggtgcgatccgccaggcggttaaagggcaccaagacgttacggaaacggtacccgcccaaacggctagcgccctggccaagctaacgacgattcccaactgggagcaactctacccgctcttagccaaccacttgattcaaacgccggcgcctctacttgaacaaacttaccaggtcaaagaaggcttagagaaccggctcaaggaggccgcggaacgccaccgggacttcacctcctttctaaaggcggtcaagaccaagcgctacacgtacggccggctgatgcgggtagccttttacttgacgctgaacttatccgaccaggacatggccaactaccacccctaccaccgggtgttaggtttcacggccgctggccaggcctacttgcaccaggtcaaaaaggagctgtcctacccgttaatcaccaaggtaaaccagcggatgaaaaacgccgaattggcccttgactaccgggcgggcaagctctatcagttcttcggcaccccggagcaggatttaacccgggggccaattcgcctggtgtaaaagccgtgtggtgtcaaggaaaaaccattgacaaggcccggggacccgggtataattaggcacgttgcattaggaggttagtaccatgaagtgggcattatctgacttacatcgttaccaagatgagccattgcacattaatagtactttggatctgaacgcatcactgaccgatcggtttcctgaaaccgttctggcggccacgccagtcacggtcgatggttatttaagctatgacaagggggatgccacccttagtgcctgcgttgagctggtgctgacggtgccctcaagccgatcccttgctcccgtagagttgccactaaactttacgatcactgaaacctacctgccggatgatagtcaccgcgggcgctacgaagaagaagatcaactggtcttgacccttggtccttccggcgtcatcgatctagatgaaatcgtgatggaaaacatcattgagcaggtcccgctgcgggtgttgacgccggctgaagaagccgccgagcgcttgccagaggggaaggggtggtcaatggtcgatgaggcaacccttgatgaggagcagactaatcaagttgatccacgtttcgctaagttaaagaacttatttcctgatcaggatagccgtgattagcgaacggttagaaaccactagtggataaaaatttttaaggaggtgtcatacatggctgtaccagcacggaagacatcaaagacccgtaagcgtaaccgtcggggacacatcaagttaaccgttccgggcttagcaccttgcccacaatgcggcgagcttcgtaagtcccacatggtttgcccaagttgtggttactacgatggcaagcaagttgttgaaaacaactaaatcaaaaaggcttccccttaggcgccggacctggggaagccctttttttatgggaggggaatcctgcattaatccttactagggttaatgagagttctatgataaaataggcgatagttaaattaggatagtgtgcgattgtaaggagaaaaagatatgagtcggattttaattattgaagatgaagaaaacctggcacgcttcgttgaactagaactgaagcatgatggttacgaaacggatgttgaactggacggccgccaggggttagatgcggctttaaaccaggattttgacgtcatcttattggatctgatgttaccggaattaaacggactggaagtggcgcgccgggtgcgggaagtcaaggacaccccaattatcatcatgaccgcccgggattcggtcattgaccgggtctctggcctggaccacggggccgatgattacatcgttaagccctttgccattgaagaattgttggctcgggtgcgggcactgttacggcggatttcaattgaaggcgacgccaacagcgttcaccaaacgacggtgacctacaaagacctaacgattgaaaaggaaaaccgggtggttcggcgcggcgacgaggtgatcaacctgaccaagcgtgaatacgaactgctcttgatcctgatggaaaacattaacgtggtcatgtctcgtaaggaactcttatccaaggtgtgggggtacgattccaaggtggaaaccaacgtggtcgatgtctacattcgttacctgcgcaacaagattgaccggccgggtgaaaagagctacatccaaaccgttcgtgggaccggttacgttatccgctcctaggtaggtggtggcaatggacgaacgaaagcgggggaaccgcttcgtctccctcaaattaaagtgggccctgggaacggcgttggggtcgttaatcatctcgctggcggtggtgatggttttgttctcttcattcacccaggacttgctcggccaagaacgccagacgctaacccaatcgttaatggccattagccaaaagctaggccaggcgtctgagagcgagctcaccgcaagtaaagttgaccaaaccctcaaggacaacgccctaacccccaaggaggcgggaagtggaaaggtataccgccgcccggttgtccagggcctgtcggatggccacctgacagtgacggtttataaccgtagtggtaaggatctctttgccaccggggaggaaaatcagggctttcaaaaggtcagtgagcagaccattaaaacggtgagtggcaaaaagcaccagtacctgatcgggcgggtaccgatccgcagttccaagacccaccaagtgatcggctacctgcaggtggaaaacaacctggataattacttccagcactaccggcgcctacaactgatctcaattttggccctcagcttagtggtgatcttttcgggcctgatgggctacttcttatcctacttcctcttacgaccgctaaatgacatccaggaaacggtggaggtcttgtccgatgacccaaccaagaatcgccgggtgccggtcaccagtcggaacgatgaattaggtgaattagcctggatgttcaacgaaatgatcgaccgcacccagcgctacattgatcaacagtcccagttcgtgggcgacgtttcccacgaattgcggaccccggtggccatcattcaggggcacatgcagctgctagagcggtggggtaaggatgaccccaagcaactggaagaatcgattcaagcggccctagccgaaacgaaccggatgaacaccctgattaaagaaatgcttgatttgacccgggcgggccaggtggaagttaactttagaaacgccaccacgccggtcaaaaagctagttaatcaggtctacgataacttccggatgattcacccggactttcacttcagcctggatgatgacctagatgaggacgtcttggtgccggtttaccgggatcacctcgagcaaattctgatcatcctctgtgataacgccgttaagtactccaacgagcgcaaggaaatccacctgtcgctctcccggaacctgcgggccgttgagattggggtgcaagactttggggaaggaatttctcaagaggatcttcaccgggtctttgaccgcttctaccgggttgataaggccaggagccgtaagaagggtggtaacggactcgggttggcgatcgccaaacgcctggtggagggttaccacggaacggtgacggtggaaagccagctggggtccggttcgctgttccggattaccctgccgatcgtggaaccaggtgacgaaaaagaagccaaaaacaaggaaagtggtaaataacccttccggcaggccggccggaagagggggaggatggtgtagcacgcaccgttcttcggcttgcttaggcagccgaccggcggttagttgccacgtgttggtctaacattcgagcataaaataagagcctgggagaaaaccgtgttttctcccaggctcttattttagtgtccccattcttttaagcgggccctgatcaaaagcagggcgagcatggtcactaagaattcggttatcggcacggccgcccacaccccggtaatgccgaggacggccccaaggccaatgatcattgggatgaggatcaagtagccccgtaaaaaggaaaggacgaaggcaaaccgcgaggacccgatggcggtcaagaagatgattgccatcaggttgatggcggtgaagacggccgaggtgaagtagattggtaaccccaccgtggcgtacttaaccagttgggcctggtgctcggcgttgaagattccgatgatcggccccttaaacaggactaaaatcagggttaataagagggccaggctaatggtgatcttaaaggcgtggtttaggatctgcttgccggcggtgaagcggtggtcgccgacttcgcgtgagattagtggctgggccccgagggcaaccccgttggcaatcgcaatcgtcacaatcgcgatgttggaaatcaccccgtaggccgccacggcgtagttaccagccaggtgcaacaagacgaggttgaagacgtagatcgaaaccccgttagccagttcgttagaggccgcggcacccccaagccgggcggcggtggcgacgcttttcaggcgcggccaagtccagtaccagtggagctggcggcccttgaaacggcggtgaaaagacagtaccgtcaggctgcagaccggtgaaaagaggacggcgagggccgccccttccatatgcagaccgaggccaaagatgaacaaccaatcgacgaggatcaccccggtggtttcggttaaagttgcgatcatcgtcaggttagggttgccgtcgtttctgacgaagttgaccacaatgtagttggccatgtaaaagggggccgccaggctaatgatccgcacgtaggttagccccattggtaaggtggcggcgttggctcctagtaggtgcaaaagtggggtggcaaagaggttgattaggatggtcaccaggatccccagtccagccacgaagataattagctggctaaacaagtgctcgacccgctcggggtgggtgagcttgtttaacgagtagtaggccgccccaccaacccccaataagagcccagttgcgttaaaggccgaaaagagggggagggccaggtttaagacggtcagtcccagcggcccggcggcaattgagatgaagagggtatcgatgattacgtagattgaaagccccagtgaggccgcaatgttacgggtgatgtagtgattactttccttgatgatgttgggggtgttggtcatagcgattctaactcctttaaagactgcctcccccaagtgggcgcctgtaagcaagtcgttagtgaaatttgtgtgggacccggcgaccccaacgttccatatttgtttcagctgtgattctagcaagaagtaacggcggtggtcaaggaggcggggttagatcaggatcccccgcaggtgatcgcactcgtgttggacggcttgggcggccagcccggttagttcgagttcttgttgtgctcccgtcaggtcctggtaggcgaccgtgattcgttcaaagcgggtggtcgaccgggtaccggttaacgataggcacccttctttggtttggtaggggtgcgcttttttaaccagccgcgggttgagcatcgccacgttaacggggccgaggctaacggcgatgatggagactggaaagccgatcatgttggccgccatgccaatgcagtggtcttggtgggcggtgagggtggcgaccaaggcttcggctaattggcggtcggcgcttgtcgccggccgggcgggttgctggaggacttgttgatcgtggttgatggggtaaatcatggaaagctcctttcaaagttgggtgtgacaacgactaaacttaatacacgggtaagtaataaagaaatagctgaagatcgtcgctttgatctccagctatttttacttaccgttgttatttgtggtggtgttgcttgccggcgttgcggtttttccttggtcgcggggcgctggcggcacccttggccggggccgcactagccggggtggtaacgagtggctcaaccggctttggtgggttcttcttcatttcttcgtggatttgcttgcggatccgtggccggtagatgttaaccaaccaggtttgcaggatcgcaaacaccccaccgatgaaaaagtacaggcctaacccggccgatgcttgccaagagatgaagaggatcatgatcgggctcatcatcagggccatgcgcatctgctttttttggtcctcgggcacgcctagcatcgatagccagccctgaattaggtaggcgacgaaggccatgatggctaacagggcgctccgttgcccgagctggaggccaaaaaaggaagcttgggccaggtctggggagtagcggatggcaaagtagagggccgaaaagaccggcagctgaattaagaggggcaagcagccgatcccaccggttaaggagacgttgttgtccttgtaaaacgacatcatggcctggctagcggccgcctgttcttcgggggtcttcgcccgcttttgccgttcctggagtgcccgcatctgtggttgtagcatcgccatgcgctcttgcatcatggtggactttttcatttggctcatcatcagcggcaagaggatcaagcggaccaccaccacgagggcgacgatggcccaaccgtaggagttgccaaagaggccggcaaaccattccatcaggtgttgcattggcttggctaggtagtcgtaaaccattccgtatggcttcccactcttggtggtgcggacacaaccactaaggagggtgagggccatcgttaggcccccggcgaccaaaaagcgttttttcttcatttgttaaagttccctttcaaaaatcactataagaacaatcttaccctaaagaaggctctaataccactagaacccttctcgaatgctgaaatcggcgaagtcggcgaggttttcttgcttaacttgcacccggtcgacttgggcccagcggttggggccagcttggattctttttaaaaaggtgcgcaccgctgcgtgctggccctgaacgacgatttcaacttggccgtcggcgcggtttttgacccagccgaccaggcccagttcgttagcaatttcaagggtcgcccagcgaaagccaaccccctgcacccggccggcaacaagtaagtggtagttaatcatggtaagatcgtcctttcgtgttgttcgtggtaagatgaatggaaatggattttgaggtgaaagaattggtagaggaattaacgtcggtcaaaaacgcccgggttaaggagtggaagaagctccagaccagaaagggacgcaagcaacaggggcgctacctactggaagggtggcatctggttaacgaagcccttcaggccgaccgcggtctgcacgagttaatcggcactaaagaagaactcgcggctcaccctgatattgtagcacgctttaaagaggtctattccgtgaccccggcgatcatggcggccgttacggaaacggtcaccccccaggggatcatggtggtggccgacctaccggatctgcatcaggtggccaccgacctgagcggagcctggctctttttagaccgggttcaggacccggggaacgtggggacgatggtgcgcacggccgacgccgctggctttgccggcgtggtcgccggggacgggagcgccgacctgttttcccccaaggtggttcgttccatgcaggggagccagtttcacttggccctgtacgagggcgacttaaagaagtggtttgaagacgttaaacaagccgggtacccggtctacgggacccagttaaacccggcggcgaaggacttccgaatcgtcacgccgcaggggggctttgccctggtgatgggtaacgaaggacgcgggatgagcgaggagttgttgaaacagacgaccgccaacctctacattccgatgcgtggccaagcggaatcgctgaacgtcgccgtttcggccggcattttgatgtttgaactggccgacgcgttaaacggttaagatccggttaaatttggttttacttacaaaaacaaagggcgattaactccccttttgttcaggaatcgtgtacaataaagtaaactaaagcaagcaaagaggtaatgcaattaatgaaatcaaagaacgaatggcgccaggacggagaatacgttgcacttgtcagtgacctgctggaacaaccagcggtccaaaagttagctaattacacgcagcaccaccactccaaccgcttgcaacattcaatcgcggtttcttacgatagttaccggctggcgaaacgtctaaacctggattaccaggcaacggcgcgggctggtttgctacacgatttattttactacgattggcggacgaccaagttcgacttggggacgcatgccttcatccacccccgggtggcccttcgtaatgccgaaaaaatcacgtcgctttccaacaaggaaaaagacattattttaaagcacatgtttggcgccaccgtggccgtcccccgttactgggaaagtttgattgtatcccttgttgatgattacgaagcggagcaggaattctttggcccagtgcgggcacgtttacgcaagcgtcgtgaacgggtgaaggcaacccgaattagttaatcatttgagggggatttgtatggatcaagcaacgatggaacggagcgacaccttctgtttgtgtccccgtttttcgcacaccttttccattttaggcaagaagtggaacgggttgattatcgaagttttgttacacgaagaaagccaacggtttaaggatttagcatctagcattgaccggtgcagtgaccgggtcctttgcgaacggctcaaggaactggaacaagaggggattgtcagtcgtaacacctacccgggggaaagccgggttgattactcgctgactgaacaggggaaagacctcgcccccgtaatggcggccgttcataactggagcgataagtggtgctaacccccttgaccaaggcagtggcaatgagtacaatgttaactgtttaaaaagacagtgatggaaactagtaactgtcacaagtagtttcagggaggtcggggtagcaactggaaccccaaccactacttcagcagcgaatttcacttccggagtcggtacttgtacccggttgattaccgttaccaatcaaaaaagtgtttggcaattgtcaagaactagggtggtaccgcgaagcctcgtccctttttggacggggctttttctttaccatcgaaaacaaggaggcttttatgagcttaaaggagcggctggaagaattacgccagcaaggactggaagaaatcaagcaaagtgacgacctggaccgggtcaatgacgtgcgggttaagttgttgggaaagaagggcccgttaacctcagtcttacggggaatgaaggacctgtccgccgacgaacggccaaaggtggggaagttcgctaacgaaatccgcgacgaattaaaagcagcgctagaagaaaagcgggcccaactggaaaaggcggtcttggacgcgaagttagcggctgaagccattgacgtgaccctgccggggaccccggtggcccaagggcagccccacgtcttacaacaaatcatcgaccaactagaagacctcttcatcgggatggggtatgaagtggccgtgggggacgaagtggaacaagaggtgtacaactttgaaaagttgaacctgccaaaggaccacccggcccgcgacatgcaagacaccttctacgtgaccccgtctgttttgatgcggacccaaacgtcgccaatgcaggcccggatgctggaacaacacgacttctccaaggggccgttgaagatgatctcaccggggaaggtttaccgccgcgacaccgatgacgctacccacagccaccaattccaccaggttgaaggaatcgtggtcggtgaacacgtcacgatggctgatttaaaggggaccctagaggcggtggcccaaaacatgtttggcgaccagctcaaggtgcgtctgcgcccgagttacttcccgttcacggaaccgtccgtcgaggccgacatcacttgctttaattgcctgggggccggttgctcaatctgtaaggggactggttggatcgaggtgttgggggccggaatggtgcacccaaacgtcttgaagatgtctggcgtcgacccggaagtttacggcggctttgcctttgggctgggcccggaccggtttgccatgctcaagtacggggtggaagacatccgcgacttctaccaaaatgacgtccgcttcttgacccagtttgaccagaaaggataagttgaatgaaagtatcataccagtggttaaaccactacttgccgcttgaacaaaacgggatcaccccgacggagttagccgaaaagatcgcccggacctccgtggacattaacgacgtatactcaccgcaaaacggcctgcaaaaggtggtggtcggcctggtcgaatcgatcaaggaccacccccaatctgatcacttgcacattgcccaggtgaaggtagccgaagacacgaccgttcaaatcgtgtgtggggcgccaaacctggtcgccggtaagaaggtgatcaccgccctggccggggccaagctggccgatggcactaagattaagaagagcaagctgcgcggcgaagaatccaacgggatgctgtgtgccctccaagaaatcggcttcaccgataaggtagcaccaaaggcctacgaagagggcctttggtacctgccggacgacgccgaagtcggggcgccggtcttttcatacctggggatggacgacacgatcatcgataccgacgtgacgccaaaccggggcgacatgctgtcaatttacggtaacgtcaacgacctggccgccatttacgccctggacaatggtttcaccagccatgaagtggttgaaaacggcaccgaacggactgccgacctgatcaaggcgaccgtcgccgaccaacaactggcgccgacttacaagctgcgggtgatcaaaaacgtccacattcaagacagtcccctgtggctgcaaatccgcctgtggaacgccggcatccggccaattaacaacgtggtggacgtaaccaactacatcctggttaagtacggtcaaccgctgcactcctttgactacgaccgcttgaccagccacgaaatcaaggtccgtcacgctgcggagggcgagcagttcaccaccctggacggggaagaacagaccctggctagccaagacattctggtgtgtgacggtgaccgcccggccgccctggcggggacgatggggggccaagacaccaaggttaccgaccaaaccgtcaacgtcgccttggaagccgccatctttgacccggttatggttcgtaagcaggcccgccgcctagacctgcactccgaatcctccatgcgctttgaacgggggatcaacccggaaacggtggaagtggccctcaacgaagccgcctactggctgagcgaactggccggcggggaagtcaccaaggggatcgttacggcgaccgaagaagccgttcaggtaacgccgattgaattatccaccaagcgggtcaacgacgtcttgggcctgtcactgagccaagctgacttggtgaacctctttgaccgcctgcgctttgcaagccaggcgcttgacgatgaccggctgctggtgcaagtgccggcccgccgctgggacatcgccattaaggccgatctgtacgaagaaattgcccgcctgtacggctacgacaacatcccatcaaccctgccgaccggcacccagacgctgggggggctaaacgaacggcaacgcttcttacgggcgtcgcggcacgtaatgcaaggggtcggtttaaaccaagccatctcctactccttactgaccgccgaacaagccgcccagttccaagtgaacccgcaagccggccagccgatgcttttggattaccccatgagttctgatcacgtggcgacccggatgaacatcgtggccggcctgttgatcgacattgcctataacgttgctcgccaagtcgacaacgtagccctttacgaacaagggcgggtcttcttgccggtggctggtcaagaacggccgactgaagaagagcacatcgccggcgccgtgaccggttctttgacggccgcctcctggaaccaggcagacgacgataaccaagtcgacttcttcaccgttaaggggatcgtggagcgctacttgcgtaacatggccgtggaaggcgaaattagctatcaggcgaaccacgaccgggccgatttacacccgggccggtgtgccgacgtcttgttagacggccaagtggtggggtacattggccaggttcacccgaccgtggccaagcagtaccgggttccggtaacctacgtcttcgaattaaacctcgaaccactgctgcaagccgataagcgcgacaagcactaccagctgatctccaagtacccggccattacgcgcgacgtggccctcttggtcgaccagaaagtaaccaacgcccaaatcgtgacggcgatcaaagaagtcggcggaccgtacctgaaggccgtccacctcttcgacctgtacaaggggaacttcctgcccgctaataagaaatccttggcctacaccttgacttaccaagccgatcaaggaaccttaaccgaagaccaggttaacgaggcctttgacaaggtgattgcccacttaaaggatcaagtccaagcagaaattcgttaaaaattaccaattgggccccagtacgttggcttgccgacgcctggggcccttcgcgtggacaacgggcgccacttgcccgatgaaagaccctctggtatactttggcggatataagaaatgaggaaagcattcatgaacgaaaatagacgcccgatcatcattggggtgaccggcggctcgggaagcgggaagaccaccgtttccaaagccatttacgataacttaaacggccaatcaattcaaatcattacccaagatacctactacaacgaccaagcagacatgacgatggcagaacgcaaggcggtcaattacgaccacccgctggcctttgacagtgatctcttgtacgaacaactcaaccagttacgccacaacaaggccgttaacatgccggtttacaactacgaggaatacacccggtcgacggaaaccgtccgggttgaaccccaagacgtgatcatcttagaggggatcttaatcctcgatgatgaacggttgcgtagcctgatggacatcaaggtctacgttgataccgatgacgacattcggatcattcgccgaattcaacgcgacatccaggagcgggggcggtcacttgactcggtgattaaccagtacttagcgacggttaagccgatgtaccaccagttcgttgaaccaaccaaacgctacgccgatctaatcgtgcccgaggggggcgagaaccgggtggccattgacttgttatcaaccaaggtccgcgatatcttggtcaaacgcggtcacactaatttaggttagttctggttgaaagcaaccggggcactgtggtaaagtttgctagtgatcttttaataaaaaggggtgcagaaaatggctgaagaaaaaagcttcccgatgactgccgacgggaaggccaagttagaacaagaattagaagacttacggctcgttcggcggccggaagtcattaaccggattaagattgcgcggagctacggggacctctccgaaaactccgagtacgaatccgccaaggacgaacaagcctttgttgaagggcggattagccaaatcgaaacgatgttgcaatacgccgtcatcatcgacaacgaagacgttgccgccgacgaagtttcgatggggcgtgaaattaccttccaagaattgccagatgaagaaccggaatcctacacgattgtcggtgaatccgaatccgacccgctgtccggtaagatttccaacgaatcaccaatggccaaggggctgttgggccacaaggttggcgacaccgtggaaattgaaattccaaatggcagcatgaaggttaagatcctgtccgttaagtaagcaaaaagcaccgctccagtgggggcggtgcttttttaggttcaaatgtgcttaggaccggcggcgagctgttactttttgccaccacgggagggcaaagaaagcggcgaaggcgcctaggctaatgagcaggccccagattagtagcggtggcacaaagtagaaggtcacctggtgggttcccggggtcaatttcagggcccaaaaggtacttaagactttgtgtaacttaacggggcgaccatcgaccatggcgtgccacccggcggcggccgggatggtcgtcatcagggtggtggctcccttcttgagcttgacggttccgctaagcttggttgacgagtagttagtaatctttaacgggctttgggccagcttgtggtaatcagccataaaggaggcttggttgagccggtacaggctgacgttttggagccaggccgaatttttctttagcgtcatggtaatggtgactgatttgcccttggcgtggtcggccaccgaaacggctacggtgtcacggtaggtgtcgtattgattgagggccttaccattccgggtgatggtcacgctgtctaggatcccgttccccagggtcaggtagtaggggtcgttagtcgtcggcttgaaggtcagccggatggcggccggggcggctgaatcaaccttggttaagacggccccggtaatctgggtggtctcgtggaggttgatgaaggtaacgtgatcaaagttttggaccttaaataaggaatcgttagtcgacttgccggccagtgcttggtaaatttgcgactggtagttgagtgggtccaacgtgtttttggagaggctcaagatctggtcgctggccccaaaggcgagtggcagggcggtcgggtttttcttaatcgtgatgagctttgaagaagacagggtagtttgacggtcccagtcgtagcgggcgctggtcagcggtaagatttgggtgccggcctgcttaccattattgttggccgtcagtgagtacttaaagcccagcagcgaatcggtcaattcggttccgttggtgtaggtgataaacccgtccccggcgggctgaccgattgagccgacgaagctagaaacactgggttccatggtcgaactgaagtgatcggcggcgttgtagtcggcctggaaggggtcgtctttggtgcgcatgaagtccttagcgatgcggtaaagaccctggtcaccctttttaatcgtgttaaccgccgcatcaagtttggctgtgtagttaccaaattcggcttgggaaacgtaggagatgttattcagggcggtaaaggcgctcgtggagacgtcgcaaacggcgagcaagacgatcaaggcgtcggttagggcgggggaggtttggcgccgcaaggttaaaatcaccaccgcgatcgccgcaaagcccgccccgatccagagctgattttgagaaatgtaattaacggagcccacccagttgaaaaacagcggtaacgccccgactaaaaagatgagggccacgcccaagacgaccggccaagagaaggtcgttcccggttcaagagtccgggcggccaaccagattagccagaagcaaaagacaaaggagaaccgcgatgggtaccagaccgggtactggccgaggtgccacaaaaggtctaagggtgaccagacgaaggaaaccaccaaaaaggcggtaaccaagagggcgcttaagcgtgccggccagcggtcgcggcgactcagtaggtaggctaagaagccggccaccatcagcatgccaacgtagatgttgggctgcccgcttggcatctggtcgaagttaaaggagccggggacgaacctagccagtatcttgagggggttgtattcccacttaaacgagaccgacgttgaggtgtaagtccccttgctcttggttaaggcaaatacggcgggtaacaagacgacggcggctaacgtggtggcgccgatcgaagccagtagataacgggaaaacgccgttacccgggggcgccaaggctccttggtggtggtcaaataccagccggcaaacaacagggtaaagagggcgaccatccaggccatgtagtagttatcaatcatggtcacggccagggcggctaggtaaaagcgccagccgcggccgtctaaaatagctaatagaccgtagatgacgaggggcaaaagccataagacgtccagccacaacacgtttaattggttggcgatcatccaccccatcatcgaatagggggtcgaaaaggccagcaggcgcccgccgtgttgctcagtggtctggtcgagcagccaggccatggacagaccggctaagccgtacttgattaagaccaaaatgagaattcccgctgacaaaaacttgccggcaaagggcaggagaattaagttcagcgggctaaacaggtagtaggcgttggttccccacatttcaccgcccaggcccttagaaaaggaataaaaaatgctggtggggtggtggagcaacgtcgaacgtaagtaggaaaagaagtcgacgtattgctggccgaggtcaacggtcaggatgcttgaggaaccaaagggggccatcccccggtaggcaaagtatccccccattaacaagacggggaggaaaaaactaatcgtcagccagagccgacgatggcgacgttgaatatgcaaaacggttaggtcctttccattacaacttatgctgtcaattatataccggtggggtgaagaaatcggtcataaaatttgcttaaatcgtggtcaaagaggtgccaagcaaccttaaaaagagtatcatctagtagttagaccggcaaagggtttgccggagttgctaaaataagtactaattttggctaaggagagttttgcagtgaatttttttaaacgctttaagaggatccttggcccgcggacacaaaacaagaaccggagtgcccagtcggtcattcccttccggttaaacttgttgctttggatcgtgggtctgctcctcttgatgcttgccattcggttgttttacctgcagattttaaacggggcaacctataaggcggatgttaaagaatcggatacgaccgttcaaaccaacaacgttcagcgggggatgatctatgattccactggcaaggtgatcgtaggaaaccaggctcaccaagccattacctacactaaggggtctgacgttaccgacgccgatatgtacaagatcgccaaccagttgggcaagtacctgacggtgtcaacggagaagttaacgacgagaaacaaacaggattacttcctggctaatgacgataacttaaaccggatgatcaaaaaggcggggctggccaaggatgtcaccgccgatacgatctcaaccagtcagtacaacaaggtgctcaagtacctcaacgcccacccgagccagtacaagctaaccagttcgcaaaagaacaaggcgatgatttacgctacgatgaccggggcctactcgctttccacgacctacatcaaggaaaccggcgtgacctcaaaggaattggccgaggtcggggaacacttgagctcgatgccgggggtgaagatcgggaccgcctggacgcgaaactacccgcaggggaagaacttccagacgatgaccgggacggtgacgacctcggggctgccgtccgatgagatcaacaccctgctttcccaggggtattcccgtaacgattcggtgggtcaatcctacattgaaaaggaataccagtcgactctggcgggttccaagtcgcagaccgaagtgacctccaatggctcgacggtggcgaagtcggtccttaagtacgccggttcgaagggcgacaacctggtcttgacgatcaacgctaagttccaaaagcaggtccaatcgatcttgaccaagaactactcgtcagccggtaatgggtattcaacgggggtttacgccgtggtgatgaaccccaacaccggggcgatttacgccatggccggaattgatcgtgacccaacgaccgggaagcagaccgtcgatgaagtggggggaatcaaccacccgatcacgatggggtccgttgttaagggggccatggtcctcggggccatgatggacggggtgattaccccgtctaacaacaccttgaccgatatgccaatcaaggtggccgggacgtcggctaaggcctcctggttcaacaagaccgggtcggccaacacttccctgaccgcctccaccgccctagaagtttcttctaactcctacatgatgcaattggcgatgaaagaagggggcatgaagtactactccggcgcccaaatcaccctgaagccatcgatctttaagaagttacgttactacttcaacatgtttggcctgggccaaaagaccgggatcgacattccgggcgaatcggccggctacgaggggccgtcaactcagtcccacattgggtcggccctggacgaatcgtttgggaactacgatgagtacacggtcctgcagttagcccagtacatgtcgacgattgccaacggtggttaccggatgaagccgtacgtggtttcccagattcgggggactaagtccaacgggagcctgggggcggttaagtacaccactcagccacaggtccaacaagtgattccggcaagtaaggcggcctttaacgtggttaaagaggggctctacctggttacccacgggacgagcccgtacgtaaccgcctcctcgcttaagagcgaaacgccgtcaatctccgggaagaccgggacggccgaaacctactacggtaccacggcgacgaccaccctgtcctttgccggttactccccgtcggataacccgcaagtcgtagtggccctggccattccgggggtaaccaattcgaacagtggtgccaacatcacgatggctaaggaaatctttgccgcctactggaaggacgtccaaaactcgtccagcagcgaataggggtgaagctctgtcaaggaaaaatccttaacaaaagggctagccaaaccggccgattgatgatatagttgtacgagttagggttgtgccagtgaagcacaacaccgtttaataaaattacaaagtttggaggcacaacacgatgcgtgtaaacattactttagaatgcacctcatgccacgaacggacttacttaaccagcaagaaccgtcgtaacaatcccgaccgtcttgaattaaacaagtactgcccacgggaacacaaggtggtcttacaccgcgaaacgaagtagttcttcgcttcatgcgcgatcgatatttatcggtcgcgtttttttattccccacgttttctgtctaacctgaaagaaccaaactagcaagcggggaccagcgtttttttacacctattttttattaccgcgatcaatcaaaatcgggaaaaacgcttgcgtcccctgggggaaactgtgataatagatctttgtaaacgtttgacaaaggagagagatttgagatgacgtatacaaaaaaagagatgcgcaaggcttacattgcccggctccagcaactggatctgaacacgcgcgttcgagaagaaaggcggctggtaagtaggttatacgaccaaccggaatgggttagcgctaaaacggtggcgataacgcttagtcaatcctttgaagttgacaccgccccgctgatcctgcacgcccggcataaaggtcaaacggttgtggtgccacgaacacttccccatcggcaaatggagttcgtggccatcgacgaagataccacctttgaagaaacgagcttcggggtgttagaaccggtggacgggaccgtcattcccgccgaagagattgatttgatggtggttcctggcgtggccttcaccacgactgggaagcgcctgggctttgggggcggctattacgaccgctacttagccaactaccagggagcaaccatctcccttgccttaaacactcaagtagccgcggaagatgaatgggaagctgacccgtttgacatcacggtgaacaaagtgctgaccccaagtggtgattaaaagtgaaaaaggccattcaacaagcgccgctaacctgctgtttggtgggtgtgtgtgtacttgtctacctactcgaagaactagccggcggggccactaattcggccaccctccttaacctgggggcgaattatggtccctttgttagggctggacaatggtggcgcgtgttcaccgctgcctttttgcacatcgggctcacccacctctttttaaacatgatggtcctctactacttaggacggaccattgaggaattgactggtcatttgcggatggccgtgatttacttggtgagcatcttgatgggtaacttggttagcgtcgccgttcagccggtaaccatttcggcgggggcttcaacggggatctttggccttttcggggccttcctctttatgggaagcgaatttcgccagtacccagcgctacggggtttagcgcgccagtacctgatcttggtgattatcaacctggtttacgacttgattgcacccgggattgatatttttggtcacttggggggactggtcggcggctttttagcgtgcgcgctcgtgggggttcctactttagggaaaatccacttgcgaaaacggtttcttggtggcgcgatattagtgttagggtttgtactactgggtaaggtggtgtttttccagggatgaaacggattgaacagctccgcaccctgtacgatgttcagcaactcttaaagcagttcaacgtcttcgtgtacgttggtaaacgcttgtgggacattgaactgatggcaattgaactcgacaacttataccaagccggcgttttagagcgggatgtgtacatgaaagccaagctggttttacgaaaggaacaccgtctcgaagaagagcatccggaaggtaaatacttaaattagaagagggattattcattatgacgaacaagaagctgattggtgttgacttaggtgggacgacgattaagttcgctatcctgacggctgaaggggaaatccaacaaaagtggtcacttcggactaacattttggatgaaggttcccacattgtgccggacattattgactccatcaaccaccacatcgacctttacaagatgagtaaggatcaattcatcgggatcgggatggggacgcccgggacgatcgacctggcaaaggggaccgttaagggtgcttacaacctgaactggaagacgacgcaaaacgtcaaggaccaaatcgaagaaggtaccggcctgaagtttgccctggacaacgacgccaacgtagcggccctcggtgaacgctggaagggtgccggtaacgatggtgacgacgtggccttcatcaccctggggaccggggtcggtggtggcttgatcgccaatggtgaattgatccacgggctgggtgccggtggtgaagttggccacatgatcgttcaaccgaacggttacctttgtacctgtgggaaccacggttgcttagaacaatacgcttcggcaaccggggtggttcacattgcccaagacaaggcggaagaatacgaaggtaattctcgcttgaaggcgatgatcgataacggggatgaaattacctctaagatcgtctttgacctggccaaggaaaacgacttcttaggtaacgaagttgttaaccaagtggccttctacctgggtctggcatgcgctaacttagccgacgccttgaacccagaattcctggtaatcggtggtggggtttccgctgccggtgacttcttgctcaagcgggtggaaaagaacttccaagaatttgccttcccaaccgttcggacgacgacccaacttaagttagccgaattaggtaacgacgctggggtgatcggggcggcttccttggcacgccggtttgcataaaaaatgttagtgggggattgaatcgtggttttagcagttagttctggtctgatgatgttaaacattgttatcttgggcttgttgattgtctgggtcggggtcttgggccttggtgcatggcgccggcgccattacgcaacggtcctcagccaagaggaattccaagcgggacttcgccgtgcccaggtgattgatttacggccaaaggatcagttcgaccggggccacattctaggcgcccgcagtgttccctacgccctgcttcgccagcaaggggtcgaccttcgtgccgatatgccaatttacctctacgatgaagggatgacggtgtcaacccaagcggcggtgtacttgaacaagcacggcttcaagcaactgtacatcttaaaggatggctacgttcgctgggaagggaaggctaaaaaggccaagtacattgattaagagaagtgggaaacaacctcctatgcaggtagtatgacttagctagggcggggttagtacggtacgtactgttctccgcccgtacttaggcactaggcctgcggttggtttccacgttatctgtgtaaccgtcgaaaattaaaagggggacgttgcattgcgacgtcccccttttaattttacaattggtgtgccgaacggttcttgcgggtagcagaacggcggttttcatcgaacttggtttcttcttcttcaatcggcttgatcacggtcttgtggaaggcaagtgccccactgacgatcgcaccgagggtcgttaagctaccaaagaagaaaccacgcgtaaagtgcttcatcaaaaatacccccttcaattctaattaacatcattatgcaagatttgaaggggctttaccagttaaatctagattaatcaaagaaagagggatcagcgatggcaaaggtagtggcaattgtgggcccgacggcggtgggtaagaccgccctgtcacttcgggtggcccaaaagtttggtggggaggtgatttctggtgactcgatgcaagtttaccggggcctagacattgggaccgccaaggcgacgacggaagaacggagcttggttccgcaccacttgatcgacgtaaaagatattcacgaccgcttttcggtggctgattttaaggttgccgctgagcgtgagattgaccaaattgcagaccggggccatttgccattggtggttggtgggaccggcttttaccttcaggccctggttgaaaacttggccctgggccgcgaccagttcgatcaggaatcggcggcgattcgggatcactggcaccaaattgcgaccgagcggggcaagcaatttgtttgggagcagctaaacgagcgcgaccccgcggcggccgctaagattccggtggcgaacttacggcgggtgattcgggccctggaagtgattgaaaagacgggtgcactcttttccacccaaccccaaccaccggctaaaaacgacttcttgatcattgggttgaccacgcaacgccccgtcttataccagcgaattaaccagcgggtggatcaaatggtcgccaacgggctccttgaagaggcaaagtggttatatgaccaggggggcgaaaacgaacaggccggcaagggaattggctaccgggagctgttcccctactttgcggggacggttagccgccaagaagcgctagaaaagatcaagcttgattcgcgccactacgccaagcgtcaattgacctggtttcgcaaccaaatgacggtccactggtttgatctggtcagccagcaaaacacgactgaagaaattgaagccttgattaacggttggttaaaaaaataaagtgaaagcgcttagcaatccattctcttttcaaaccagcgagaatcgattgattttaacgggtggggttgttattattgatccatcgatttaaaaaagccgatcaataacggcggcggcggttaaggatatgacctagaccaatcgcctaatgatcggcgatgttacttgatgatacagaggaaggaatagcagacaatggcaaaacatgtttacacgaatgacgaagtacacgccctggttaaggaggaaaatgttcgctttttgcgggtgaccttctcagacctctttggcacgatgaagagtgttgacttaccgattagccaacttgacaaattattagcaaacaaggtgatgtttgacggctcctcgatcgatgggtttgttcgcatcgaagaaagtgacatgtacctgtacccggacatgtcgacctggctggtcttcccatggggggcagaacacggtaaggttgcccaagtgatctgctccgttcacctgacggacgggacgccatttgctggggacccacgtaacaacttaaagcgcgtcatcaaggaaatgaacgacgccggcttctctgctttcaacatcggtccagaaccagaattcttcctttttgaaaccgacgaaaacggcaacacgaccaccaaggttaacgaccaagaaaactactttgacctggaaccagctgataagggtgaagactgccgtcgcgacatcgttttggccctggaatccatgggttacaacgttgaagctgcccaccacgaagttgcaccgggccaacacgaagttgacttcaagtactccgacgccttagaagcggccgacaacatccaaatcttcaagttagtggtgaagacgatcgccaagaagtacggcttccacgccaccttcatgccaaagccactggccggcatcaacgggaacgggatgcacatgaacatgtccttgtttaaagaagaaggcggcaaggtggtcaactccttctacgacgaacaagacaaggttcaactttcgcaaaccgcataccaattcttggctggggtgatggaccacgcccgtagtgtgacggcggtctgcaacccgatcgtcaactcttacaagcgcctggttccgggctatgaagcaccagtttacgttgcttggtctgcctctaaccgttccccaatggtccggattccaagcgagcgtgggatggggacccggctggaattgcggtccgttgacccgtccgctaacccgtacctggccattgctgccatcttagccgctgggctggacggtttgaagcgtggtttaaagccggctgacagcgttgacgaaaacatctacgccatgaccgaagcagaacggcaagccaaggggatccacgacttaccagacaccctgcacaacgccttgaagagcctggcccaagacgacgtgattaaggcggccttaggtgaccacctctaccgctcctttaatggggctaagagcttggaatacgaaggctaccgccaatccgtttctaagtgggaacaagacaagtacatgagcgaatactaaacacgactgagagtggaaaataacctactcggcaggccgtatgtaagatcgaacgaacggttggtgcgtcacgcaccgttcttcggcttgcttaggcactaggtctgcggttattgcccccgtataatagtaaaaaagctcccgccggttgtggcgggagcttttttaagcaattattcgttttctaacttcttcgcgtcagcgtcaatccgggcaaaaccagagccatctggcttcttgctcccacgcttttccatcgcctttctggccatttccttacgttcttgcttgctaagtgccattgattattcgcctcttttcgaattagccattcaatgctctacatttgtaaagtactgaatacgattattatagagcgaattgaataacttgcaagctactttgataattattttgatatcggaccggcgagaaccccttttagttgggccagtgcgccttgtttcagaccgtttggcgaagcggattagaattaatggtgaactgactttaaaaaagggcggaaattagctaagataaagctataaccatgataaggagaaactcatatggcgaatgaagaacaacagcacggcgccgttagcattggagaagtgattaacggccagattgcgaccaaaattgattatctgcaacagttacaaaacgccattgcggatcatgatgactgccaggtctaccagctgctcgataaccagcgctacgctgccgaaatcgaacaccgtgagcagcaaccaaacgactcgcgggtgatgaacctagtggataacttggctgaccaactcagcaactacttaagcagcaacctgattaaatacctcggcaaggcctaccccttcttttactatgaagaataccagaccggccactaccgggtttactttgggaactggtgggaccgtcgccagttcggggagctggacgtgttaaacattcgcttcatctttaaccaagaagaatacgataagctcgcccaggctttcaagctgtcccaagccggcaagcgttacaacagcaagcggatcggggaattgtccaaggaaaacgaacggctacaatccttaattgacgacgcgacgactcgcgaacagcggcgggccgaattgcaagaggaactaaaagacatcaccgcccgtagcgggatctttgaatccagccgcaaccgggagagccgggagtcgattgtcgaagagattgctcacctcgaagacctcgatcaagaggcgcggacggcggcggaaaacattaagcaaaacgaacgcacgatactcgacttgtccaaggaaaacacgatcctttcctacgagcaaaagtcgattaacgacgtctttggctcctttgaagactttgagttagccaaccggagcctgtacgccaactatttagctagcctgagtggcggggccagtgacgagggaaagcgggggagtaacaatgagtaacagtcaaattgtttccacggccaccgataaggtgcgggccttgtcagcttctttaaaggatggtttgttagtggggaaacgctacgtggacctcttaaacgaattggtggaaaccaatgaaccccaggatctgttgtcggcaaccgaggagttagtcaacttaaacttgaccaacgccttcgtgaaattcccccagcactaccaaccggctgattactacctcttgtttatgagtcgcatgctggagctaaacgccatcaacggggtggcgattagccaacacaaccacgctttacaagcgaacattcaaccactagaagagggtttaacctttaagtttgagccagccaatgagcatgcgggggcctttttcgccgaccagcgtcaccacgaaccactcttttacattgacctggagaaccggttattgaacttttcaaaccaggccttggtcgacttctttattgttaagcaggtcaacaactataacgacttggacttagaagaggccttggcaccgctaatttcctttgcaaagctgttaaaagaccgcttagactttcggattgacctcgggatgctttcgacgagcaaccagaccgtctttggcttacaaaaaccagacctcgatatggccgtaatcgacaagctcttcatcgatacaaccgagacggattacttcttgatgagtctgccccaaaataacggtgcccagctgaacttagaccgcggtatcaaactgcaactgggctttgatcccgaggattacagccagcagtggggctttagggttctggacgaaaatgagcgttcctcgttcttcggtattttgttacactacccgattgtgcgggactggtacttaaagaaccgcgcagcgttggccattcaaaccacccattttgcaccgcggctaacccgggcccaggtaaaagaggaggcgcccttagaagatgcttaacatcaccgttttactgcaggacgtcatcgcaactgacaaccgcctctttgaagcaaaggacgtcatgctgggtcctgaggcacgcttagctaacgttgtcaccaccctcgacattgagctggccaagctagcaaacctagttggttggagccgggtgtacgatgagggtgaaaaaccagcagctaccgacctagccggccagtacaccaaggttctccacgcggccctgctgatggcggcgcgtaagcaatggacgcatttggtagttttagatgaccaggccttcacccgtttgttagcggtcaagccggccaccaaggtagcggatctcaacaaggagtacttggccatcaaaaactttaccttgggcagttacttcagccaccgccaagaagacttccgtcacgcctggcacttgctcttgaagctgggactggtggacctcggcgtttcggctgaccaaatcatggccgcccatcaacaactaatccaacgggctgaaagaaccattgccaaaacaaactaactaaaaagggaaaccgcgagcgaacggtttccctttttgagtgagagcaaagactatgcttttcgttgaaaatgttttccaacggggtggcttcgagatggattgccaaagtaaatttgacctgctacagataaagaaagaattaacacaatgataaagaacggtagcatcttttcacccccataaacattgcctatccttattattgcccattttgcaaaaaatgcaatagctttgtaaactttttgttacattggattgatttatttgaaataaagaatttaatcgccggctatttgcaagttattcgatgaaaaaagttataatataaccgatcgaagatgaattagtcgttatccttgatcttacggtgaaccagcgctgcgggagtgtgcaggtaagagatagaaaaaattcagctccttaccacaggggcaaggagctgaaagtgtaacgttaccgttttaaattaatgctgatgagacgggtgggcagtaacactactccacaaatgttgatttaacagcattcttgagctaaccgtgcaccaaatgtgcaccattagatggattcaagcgcggcgatgatcagttcatcggtctgggctttgtactcatcgatcaagtaagcataagtgttagacgtgatcacggtcgaagagtgaccaagccgcttgctgatggcgtagagatcaatgccactcgctagcaagagcgccacgtgtgagtgacggagactgtggaagtggaagttctgccggttaatgcctaagtcggccaagagcgttctcagcgtcttattgacggcgttactggtgggaatggtaccaaactgggtgaggaaaaccatattgcttttagaatgcgttctaagccctctcagaagcgccaggagatgacgattcaccttgatgacccgattagacgattccgttttagttggcttgaattggtgtgtatgggcgtcccacgacttgttgatcgtgattgtagatttaatccaatcaatgtccgaccacgtaagtgcctgaatctcagctaaccgcattcccgtgtaaatcgccgtcacaatcatgtggcgggaagtgtagtgatgggttaatcccgcttcagcgtgttggattaagcggtgaatctcagctttgttgaggtagtcgaccttgatcgaccgtgacttatcgctgttcagctccacaccttgcgtaaagtccttgatcagatagtcatcaagtatcgctgatttaactgctgatcgaatgtagctgttaacctttttaacagtggacggcgcgtggcagctgccatagtcattgatgaactcttggtacatcgtcctggtgacttgcctgattggtgtcatcttaaagaaacggcgcacttcgttagcggtgtagtagtaccggtcaagtgtgatcttcgccacctttggctctttgtaagtcgtaacccactgatcaacgtaatcggcaaaggcgatttccttatcggtcaggattcctttggccaagttagcttcattctcgactgcccactttttagccaggctcttagtcgcgaagccgcctttgtttttaaacctccgttttccagcagtatcataccagctgatacgagcttgccacttaccagacctttttacatatgacgccataattgcacccccttaattaaacatgcgttcgttttaatggcttttaaaaccggccattatgaccggcgcttttttatttgatcgtaaatgaccttccacagtccaagcatacccagtcacttttttggtttgcttaccggcaaaaccagcaagagcatcaaccccgacaattggactagttagcacggttccaccaacggccttaccaactgaaaatccccctttatgaactccggcagataacgaactttttagctaccaaatgtcggtatagttacttggaaaatgcatatcttgtaataatgctgaataattaattggagtaaaacgatctttaaattcttttagtaaaataccgatatctttaattagtctttgataatttcttctgggaagaacggctttcattgctattataagttcgaaaataccggcctgactctctaaaggaacatttctgatattggctgcgacctttatgtcacgcatatgaggagttcgttgaataatttttgaataagtgatttcaccgtgtgcaactgcgtttctgaaaatattaaccatttgattgatatccataattgcatttggcgtaatggcgggctgtgaactgctattgtacgaagcttttttagtatgttggaagtcttttgcaattgttagttgtatatcctgtgtacaatttgagtaaaaataatttaattcaccaaatgtcaagaaatttacaagaacccagagtggaacatgaccatgcttattaacataatgttttatagcatttttacccttgcgatcggaagaatattttttaatcgtactagaaagagaacttatagtaccaacaactgaagaaacttgttgaggatttctagaaaaattatccattgctaaataagcatgttcttcttgatgttgttcagaaaaacggtatgcaatttctgctcctaacatagtttcgtatttaagtaaagcacgatatagaattgctcttagttcaaagtcgaaattatacaatgatctaatttcatcaaaagatgtatcctctttgtatacttctggatgaattatgttcccgtttgaatccctggctaagaacatccatttataaccattgattaaggaataatatcccatctgttctaatgaacgtttagctttagcatgagcatcatcaagacctctatcacgtaaaattgataattgctgatttaatgttttgaatggtttagaattaattgtgtccgacaagaatttcacctctaaaaaaacaaaaaccctagaactgtacgaacgtacagctctagggttttgttagtccaacacctactcctagggccctttggacttgatctgtacgtttattattgcaaatagtaacaaaactgtcaatgcttttcccagcttttaacgtcgatcaggttttggacgtatcaagttttaaatatacgagataagcatattctgttggtatcccaaagcgataacagaaagcaagaggattatctggtttttttatttggagctagttattttctacaattttgtaagtctttgtgccgagcacttttccatctacacctttagatgctttcaactgtactggtgttgtggtgtccgaaagagtataagcaactgcgtttgaaactgtgccattcttttttattgtctcagtttgactatctaaatattggtcatctggcaacgacgcaacttcaagttcattgatactatttttgtcgttatcttggatagcagtgaacacggccatccatgctgatgttggatccaaatctttatcagttaggttagttgtatcataccaaactgcgaatactgccttatcgccatcgacgtttccaggttgcccgggttgaattatttttgttttagtaattttgatttttaaatcatgaatttttactacgttatctttaaaataatattttggagtggcagtctttttgactgtcgctttttcatttgaagatgatgaacttgatgaattatcacatgcagctaacgataatcccataatcaacgttacaccaataactaatccttttttcatatttacatctcccaatatttctagcttttaacgtcaatcagggttggacgtaggatttttttatttgtacagtttgaccccgccgcttaacgtcatgcgtgcaaccggattgccgttttggtcgtaaaacgataccggcgcattagcgttgtggctttcgagcagactgatcacactgccgtagacttctttttgctcgttgtcggtcatggcggcaacactgttaggcacggttacgtaaaactggctgtctttgtaggcaatcttaaagccgttaagtgtagagtcgctcgccatctgactggtcaaatttttagccagcgcggtatatgtagcatcatccatagcctggtcacgtgactcgctcttggattccgagattgactcggacttggcctttttagacgacgcaatcgacgacgattctgctgcccgttgcttatccacattatcagcgtgagtaaaaccgatgatagtcacaccgaccaccgctaagagcagagcactgattttaccgcctttacggtcacgattgcgtatccagtaccagacagccaacagcagaaaaagaaaacctaaaatcatcataaataatcactcccgataaaatcagcttttaatgtcgtcagaatttggacagttttcgcgaatcaaattacgcacggtatagtcaagagattggctgagattgtggcgctctaagaaatcgattgagttaagctcgctggggtcgcagctgtcgatataatcactaaccaccttatcaagcatgtactcattagcgtctttttccatgactatctttgaccgccagtcttgataggattgacagccatcgtttttaatatgcccgatttcgtgcagaattacttggttttccattccatcaggcatcccgctgcgcataatgataaccatgccttttggcgtattaaaaagccgggctgtaaattctatttcgtttgtatattctattttaatgccatatcgcttaagcagctttttgattgatagatccatgcctatcaccgccattcaacttagttaaaatacccgcgtagaatctttttgacgatttctctatcatggtcagaaattggtttgccatcaaaactgcgcgatgcatcaatagctttatctaagtcggtttcctgctctatatgtttcctatccggtatgctcctgcctaataagtagtccgttgagacatcgaaaattgatgcgattttatcaagttcttcgctagaaacttttcgggtacttttttcaattttattcattgatgatttgtcgataccaagacgtttggccagttctgattgactcatgttaaccttttctcgcaggtcgactattctggcagctaattgtgtttgcattttaacgcctccttattaccgccattgtgtgcggcttctattacaatttctattttagcaatgtttctaaaaaagatacatatttttgagaaaaaagaaactttattgttgacgtttctaaaatagaaacgtataataaaaatcgtggttgagataatcgcaaccgaaaggaagtgaaatgttgacctactcgattaacatcaagctaatcaagcagaaacgtttggaacacaaatatacgctccaggaaatgtctgaagtgctagggttagccaatcgttctctttatttaaaaagggagaatggctaccaaaaattcaaggcaaacgaattaccactgcttagtaaaaaactaggcattccattgaacgatttttttattccaaacgttgagaaaagctcaaaaggagaaagataaatggagaatttggatactaacaaaattatcaaatacgctggcgaatccaaacaacaagtaattgatagtcgggacgttgcgagaatgattggtaagactcaccgtcatctaatgcgtgacattcgcggatacatcaatgatatgaaggacagtccaaaattggactctcctaaattcttcattgaatcaagctatatctcatctcaaaacaaggagcttccttgctatctgctgactaaacagggatgtgagttcgtggctaataagctgacaggtcgcaaagggacgatctttacagcaacgtatgtcagcctattcaacgagtatgaggctgaacataacggcaaggcagtcgcaatcgacagtggtctggagcatgaaaagctcgcgtacaagcgagaatggctgattgaaatgcgcaagcagaacgtcaacaaagcgcacgagttacgcaatcaagacgtcaagctgtatctggagcttggcaaagttgctgacgattaccagcggccacgtatggccaccgacttccgcaatgaagcgatccgtgccatgtcagccttgccggtcggtgcacggcgggaatactcagcgaccgagattggcaacatcattggcgtatcgccaattgcaatcggaaagtgggccaacaagctaggggttaagcgtgatgccgatatgagctaccgcgatcacgatggagcttggcgatacttccctgaagcactaaaagtgttccaggacaacgcattggagatccaagatgacgatttaggactgtaggaggtggtggcaatgagaaccgttgaagagttcgaaaaagcaactaacaagtgtcaaaaaccgatgtccgattatgcacggatcattgttgaaacagatgaaaaaagccccaagaccttagcggtgatcacagatgacgactgtgaaaccgtagagggcctcagggttcggtttatgccggtttataggaattaatccttatccttaggcggcattgggtcattaccatatgagttctttaggttgatctgaccattacgtttctgactaaccaattcagcatggctattaatagcttgttgacgaccggctttaatagcttctgatttagtgccatagatcttagaagcacgggaacttccagaactttttacagcccaaccatttgaacggggactaacccaaacttgctttgacatagtttcacctcctttcatcaggagatgacttaattctaacagaaaggagaggttgatagtgccactgcaaatagatgacttcacaccggacttgatcgcccaactctatgagcagattcggccgatgttcttgaaggagtatggcttgcccaggcgccaagaggtcgacaagatgatcggcctagacgaattcattgggctcttgccgatgcgcaagggcaaagaatgggtcaaggcctacatcttcgaaggccacccagaaacgcaggcatttgtctacggactaaacgcaggacgaggacacccgattaagattaatgaacgcaaagcaattgaatggatcaacgccaatgtcgatttgatcgactggcgagccaagttataggagggatagagatgggaccattactggtcatcatggcggtcttcttgatcgctttggtggtcaacaacgttctactcacggagcgttgtcatcgcctggaaatgaagctacgcaacgaacactacaaggaggactaaccatgaacgggactgaatgcttggcgtacggagcactatttgtcttagcaatcgcactactgctgacaaatcacttgatcctagcaacggtggcaattgtgccgcttgtattaaccagcttcaagtacagcttttcacaacaaaaaaaggcccagcgaaatcgctaggccaaataaaaaaataaatttaatccgaatttttggacaaatttgtcagcataacctgatacggtgtttgccagtcgagtattttaagcggtcgctggttaatttggagtaacgtcgtcgttaaatcttggaatgcaccacactatcaagtagcaggtaaataaacagtcgtacaggcgttttaaatagtgaatagtgggaattatccatcacgcagttataacggcttaaaacggaccagagaggcgaaatatagagggtggcgaaaaagcacccccccgccctaccgcctaaaaaggtagagcgcacacattgccatccactcacatgacgactatgtttttcaaactttgacgagggggccagaccgttcgcagttcctaacgacatatattgtcgctaaagtggagaacgtggcaaatcgtcccggattaggacgactaacagctccctagccccaccaagtgatcgcctggtggtggatgctggttagtaattagcctaagagccaaacacggacccttatttcttgaagcaggtcacctttacaccatcgaagttgaccaaataaaaaaagagctatctatatcagatagcccacattgcgcccttcccttatttcacaaacttttcttcctggattttgaccccaatttgaccccaatttggggttaaaaccatgtttactaatgtttagtaagaataaaaaatgccgtcatcccaaggatttaaccatccctgaaaatgacgacaataaaacttagtgccccaaacaggattcgaacctgtacatggttacccatacaacgacctgaacgttgcgcgtctgccagttccgccactggggcataatattcgtttttaatgcgcccccggggagtcgaaccccgatctcgagaaccggaatctcgcgtgcgatccattacactaagggcgcgctacctttttgcgcatttctttgcctcgctgctttgttatcaagcaacgtatataataatacacattcagcgcctttttgacaagccccttttttaaattaattttcctcccctaaagcgagcatctagaccaatttatatcaaccggttgtttaaatttggtcattaaaaggacttgccaactagaccattgagggatatgataggtattgtcaattaacgacgggcattccctcgtcattaaccaatttaaaacataaaccaattaaataattatggaggacctagaccatgacgaaacacgaacggatgttagcagccttagacgtttacaaaaacggcaatgacaaagcagaaatgagtcaattggctgccgaaagcgccagcgctgaattagatcttttatgccaagacctggatgactaatcactaatcatctggctcgccgactgtcccggggggagcaccgccttctatggccgaactctggttaagatgctgatcatctccaccttttttctacctaacatttaaaaagctagcatgagtccgtgagagtactttactcgcggacttttttcacaccaagtgtcaactaatcgaggatggccccacctcgttacttcttgccgttcacattaatttaaaaataattctctcaatatgttaacggtgtgacagattgcgaaaacgcccccaattaggcctggtccatgccaatggggtgaaaaacttttgccaacgagtgggtaaatgatttgaccttttttgacctatagagtagactatccccataagttagcaaacagtactaactagtgctaattaaggaggccaactgaatgaacttagtaccaaccgtcattgagcaatcgtcccgtggcgaacgcgcttatgacatttactcccgtcttttaaaggaccggatcatcatgttatctggtccgattgaagacaacatggcaaactcaattgttgcccaactgctcttcttggacgcccaagattccaccaaggacatctacttatacatcaactcccctggtggggtggttacctctgggatggcaatctacgacacgatgaacttcatcaagtctgacgttcaaacgatcgtgatcggaatggctgcttcaatggcatccgtcctggtttcctccgggaccaaggggaagcggttcggtcttccacactcaactgtgatgattcaccaaccatccggtggtgcccaaggtcaacaaaccgaaatccaaattgccgccgaagaaatcctgaagacccgcaagatgatcaacgaaattcttgctaagaactccgggcaaagcttcgagcaagttgaacaagatactgaacgggatcactacttaaccgcccaagaagccgtggattacggcctgttggatggggttatggattcaaacaatctgaagtaacccccgcatctaggcactaggcagaatttatttctgcttggtgccttttttgattgacagcggggtgcccctcttttattctggggctaaatttaaattgagaggagctcaccatgaactacaccgaccagtggcgccaagccgttttaccgacctagcaagctagctttgaccacccctttatcaccgccttgcacgacggaaccctgcccgaagacacctttcgctactacctcatccaagatcaccactacctcaccgcctttgccgccctccacgaggccatcgctgaacacctaccggccgatcaagctcaggtcttgttagccctaaacgaagggagtggtgaagacaccatccgcgacaagatgcacgcggagctagggatcaccgctactgactttgccaccacaccggtcgccccaaccgcctacgcctacattagccacatgtattaccagctcaatgaggttaacccccaggccgccgtggccggcttgctgccttgctactggctttacgcccaaattggcgcccacatggccaagttaactagtcccaagccactctaccaagccttctttgacgcctatgctagcgacgacttcaccacgtcaactaaccaaatgctcgacctagttaaccaaaccgcagccgctagctccccggacgtgcaaacccaaatggcgacggcctttaagcgcagcgccgtttacgaaagccacttttggcaaatggcctaccaaaaagaacggtggtaatcaaaagaagcgtgcggcccaacctccgatatgggccgtttgaccaagctagagcaggaacattagttttaaagacaacaagaggctgcgagaaattcctcgcagcctcttgtttattatttagattaccttgccctgccgcaattcgtcggcgtaggcatttagcttgcggagccggtgattgacccccgactttgaaatcgggcccccgggtaccaacgtccccagttcctttagacttacttcctggtgagccaacctagtttcggcgatggcacgtagcttttcagggaggctacttagccccaccgtcgcctcaatcagcataatattttccacctggcgattggcggcattggccaccttatccatattggcgttctcacaattaaccagccggttgaccgaattacgcatgtcgcggacaatccggatgttttcaaattcgagcattgaagtggttgccccgatcaactgcaagaagttcgcgatcttttcggcttcctttaagtagacaatgtagccactgcgccggttggtggtgcgggcgtttaggtcatagcggttgatcatttcagcgatcatctcgttgtgctcttcatacaaagaatagatctcgaggtggtagcgcgacgtctccgggttattaacggaaccgcccgccaagaaggccccccgcaagtatgacctgatcatcaagtcgtcggtcaacaagtccaagggaacccgttccttgatttgaaaaccgtccaaaatggccaggtcccccaagatttcctgggcgtggtggcgtaagcgaaccacgtaggtgttattctttttgagtttcattttcttgcggaccagaatatcactttctaccttgtaaagttgcttaatcagtgaatagatccgccgggcgatggccgggctttcggtctggacgtttaaaatcatggcatggttagccagcccaatggagccgttcatccggatcagggccatcaattcggcccgggcgtttttttcgtgtaccgtgatcccggtgagttctttcttcacttcgctagcgtaagacatggaatctccccttcagtttagtaatgaacgtcatggagccggttgatcagctcttcgacgaccttgtcgcgatcatggaaggccccgttatcgcgcaagcgcaagaagttactagaaatcacccggcaccccatttcccgcagggtacggaaatcatgggtaaccggctgtgaaatctcattccactccttaaagtcaatgtagtcgtttggcaccggctgaatgttgaccaagacggtatcgacaaagttctttcccaggtgcttatttaaaacccggacgtggtcggcatcggtgaagtgatcggtctcccccttttgggtcatgatgttgcaaatgtagaccacctctgccttggtttcacaaaccgccctcccaacgttttcgatcatcaggttcggcaggatcgaggtgaacaaactccccggccccaagacgatttgatcggcgtccataatggcctcgattacctccggcaccgcttctggctggtggtgttccccgtcactaacccaaacgtggtcgatttgcccgtgggcggccgtaatctccgactcgccccgaatgacccggccatcggcaaaggccgcgtttaaagtcagcggttcgttggcaaccgggtagatgtgaccatggattttcatcatcatccctagttcttggacggcctcaaaaatcccgccccgcatttctgccaaggccgagatgattaaattgccgatcgcgtgccccgccaaaaattggtcggtactccggaagcggtactggaaaatatccttttcaatccggggcatttccgccaaggccaccaaggcattgcgaatgtcgccagggggaaccacgttcacgtaatcacgcaggatccccgatgagcccccgtcgtcagcaacggtcacaatggcagtaatatcaacattatggtctcttaggccgcgtaaaatgattggcaggccggtcccgccaccaatcaccacaaccttcgggagatgatgcatcaaaacgactccttctttctgttagttggccttgtccacgtcacggtgatggacgtgaactgggtattggttattcttcaggtcagcggccagccggttagcaatcgttactgaccggtgttggccccccgtacatccaatggcaattgtcaaactactcttgccctccttgatgtatcccggcaaggcgacttcaattagcgaatacaagtgttggtagaagttttgggccagcggattatccattacgtaagcttggaccgccggatcgttccccgtctggtgctttaggtctggaatgtaatacgggttaggtaaaaaccggacgtcaatcaccaagtcagcgtccaggggaagcccgtacttaaagccaaaggacatcacattaacgtaaaacgagtgggcctcgtccggtgaaaaacgttccgtaattcgttgcttaagctggcggggcgtcagggtggtcgtatcaaccaccagatccgcttgcgacttcaggtcgtttaacaactggcgctcccgcatgatgcctggtaaaacaccatcttggtgactcaaggggtgggcccggcgcgattctttataacgcgaaactagctcctcgtccgtagcctccaaaaataagagccgtaacgtaagatcagaacgcccccgtagttgcgctacgcacggcaccacctgatcgtaaaatccccgtgaccgggagtccatcaccattgccatccgggtaatttcaccggactgcttaaccgcgtcaacgaacttggtggccacgctaggaatcatgttgtcaatgacaaagtagcccaagtcttcaaaggactggacggctaccgtctttccggccccgctcattcccgtgatgatgaccacttctaattgttccgccattatcaaagcctcccgtcttttcaaacacccgtctattgtaacacaccgggcgtgtcatgcctagcaacgctacccggcgtatcaaaaaaggaggccggaagcatcgtttctcccggcctccgactgtattcacgaacgttagacagaaagtgtgccaaccaaccgtggcccttcacttggggctacgtggttggtgagtttccaccttcttgttacgcctagttactttcgggggttcccttttcggttttgatatttaattccttggccaggttagcgaccgacagaatcggtacctggtgctcttctaggtaacggaattgcgcactcttcttgctggccgcccgtggcaccgtactattggtgtccaaaagcaagccgagccgggcttcctttggtgaaacccgcttaaattggtgctggtagtgattagccaattggtcaatcacggactgatcgttggtgatccgggcctgcttggggttaaagaccaccgccaccggtacgctaccgtcatcttgggccagtttctttaaggaaacggggtgctcacttaggtcaaccaagtgacggtcagccggttggtcaattaccatcggcacctgcttagaggaattggtgttggtcgttgcattggcggacttggtcacttggcggtttcccttcttggtcgccttggtccgcccagcctccttggtagacttggtattggtcggggcctttttccaactggcaatttccggcagggcgactaagtagtcgtaaacctgcgcggttaacaagacatctgaaagggcatggtgcatatttgagacgtcaaagcccagcaaacgccctaccccacgcaggctcggtttattgggtagttcccctaaccagctgaccaactcgtcaacttcaaagcagcagaccgccttctcatcaacgagcgggccaccgtggtttttaattgcctctaacaacacctggagatcgccgtggacgttccaccccccaatcggtaggctaaagtcgataaagtttaagaggtcggcaacgatcttatcccactgtccctgcttcttgtaggtcttgtaggtgacgttggcgtaatcaattccacgcaaaatatcgtcggcctcggcgtcggcccagtaaacaaagcggtggaattgcttaccgaccttgcgcccgttttggtacttgaccaccccaatttctaaggggaggtgctcccgggtctttttatgggtggcaaactcaaggtctagcatgtagtacttgcttggtagactctggagtttggccagtttcatttcttgcattctaaaatcctttccattaggtgatttatccgaacgtgatcgttaaatcaaggataggagggcgcgcccctttttgtcaagaaaggtccttacttcttctttttagcggcccgttccgccgcccacttggcatcccggtccaacatctccttgaggtagtgacccgtgtaagaagctgggacctgggccacttcttccggggttccggtagcgacaatttctccaccggcttgccccccctcgggaccgaggtcaatcaaccagtcggccgacttgaccacgtctaagtcgtgttcgatcaccaaaacggtgttcccagcgtcaactaggcgctgtagcactgctagcaggcgcttgatgtcggccatgtggagcccggtcgttggttcgtcgaggatgtaaaaggaacgcccgttagattgacggtgcaactcactagccagtttcatccgttgggcttcccccccggacagggtggtggctggctggccgaggtgaacgtagcctaggccaacgtcttgaatcgtttgaagcttacgccgaatcttgggaatcgcactgaaaaagtggagggcctcttcaacggtcatgtctaagatctgagcgatgtttttgcccttgtattcaacctccaaggtttccgagttgtaacgggtgccgtggcaaacctcgcagggaacgtagacgtcgggcaagaagttcatctcaatcttgataattccgtccccgtggcaggcttcacaccgtccccccttgacgttaaaggagaagcggccctttccgtagccccgtaacttggcctcattagtttgggcgaacaggccccggatgtcgtcaaagacccccgtgtaggtggccgggttcgagcgcggcgtccgcccaattggtgactgatcaatgtcgatcaccttttccacgttttccaagccgcggatctccttgtaacgccctggcttgtcgctggcccggtttagttgctgggccaggatccgcttgaggatctggttaaccagggtcgacttaccggagccagacacaccggtgacgcagataaacttccccagtgggaacttaacggtgatgtctttgaggttgttttccctggcccccacgagggtcaagacgtggccattgccagatcgacgctcgctgggtaccggaatcatctcccgtcccgacaggtacttaccggtcaaagacttgcgtgagcgcataatctgtttcggggtcccagccgccatcacctgaccaccgtcttcgccggcccccggaccaatgtcgatgatgtaatcggccgcccgcatcgtatcctcatcgtgttccacgacaatcagggtgttccccaggtcacgcatcttcttcagtgagttaatcaagcggtcattatcgcgctggtggagcccaatcgatggttcatctaacacgtacatgaccccggacaagttggaaccgatctgggtcgccaaccgaattcgctgggcctcccccccggagagggtccgtgccgaccgggagagggtcaagtactcaacccccacgttttgcataaaggtcagccggtcgagaatttcctttagaattggccgggcaatctcttggtcttgttcagacaagtgaacccgctggaaaaagtcaatttcttcagaaatcggcagttccgaaacctgaccaatgttttggcccgccaccttcactgccaaggcctgttcgttgagccggtaaccgtggcaggctgggcacggcaactcggccatgtacttacgcatctgctcacgggtgaagtcggagttcgtttccttgtagcggcgggaaacgttattgaccaccccctcaaaggtcacgtcgacgtcacgaatgccgccaaagtcattttggtagtggaagtggaaggttaagtcatcaccgtacaaaagctggtgcttggtttggtcatcgaagtcttcaaagggggtgtccatgtcaatcccggcggccgcgcagtactgggccaacaggctggggtagtacttagaagagattgggttccacggcactaaggccccctcgtttaaggtcttcgtttgatcgggaaccacgaggtcgacgtcaacttctaacttactcccgagcccctcacaaaccgggcaggcacccagcggggcgttgaaggagaacaaccgtggttccagttcgggcatcgagaagtcaccgtacgggcaggcgtagtgttcggaaaaggggatcttctcaccgccaataatgtcggccaccgccaccccatcggccaggcgcaaggccgcttcaaaggagtcaaacaggcgtgaacgaacgccgtctttcacgataatgcggtccaccaccacgtcaatggagtgcttcttgttcttctccagttccggcacctcatcgacgtcgtaggtttcaccgtcaacttgcacccggacaaagccgtcctttttgatcttggctaacactgccttttgggtcccccgcttttcgtggacgaccggcgccagtacctgcaggcgggtccgttctggcaactctaggatctggttaaccatttgctcaggtgattggctggcaattggtaccccgtgggtgggacaaagcggcgtccccacccgggcccacaagaggcgcaagaagtcgttaatttccgtcaccgtccccaccgttgaacgggggttatgggaagtcgttttttgatcaatcgagatcgccggcgatagcccttcaattgagtccacgtccggcttatccatttggccaaggaactggcgcgcataagccgacaagctctccacgtaccggcgctgcccctcagcgtataaggtatcaaaggctaaggaggacttgccggaaccagacagccccgtgatgacgaccaacttattcttggggatcgtcacgtcaatgttctttaagttatgtgcccgggcaccccgaattacaatcttttcgtttgccatcaataactcctatttcttcttcattcgactagtcagttccatgaccgtatcacgtaaagtagcggcctgttcaaagtctaggcgcttggcggccgccttcatctgctcggttagctcggcgatcatctgggcctgggcctctttatctagggccgcaaagtccttgctggtaaattctgcccccttatcggcttgctcatcttctaccggcttaacggccttaattgcctcttggatcggcttaatgatcgtctttggcgtgatgccgtgctccttattgtaggcctcttggatcgtccgccgccgcttggtttcgtcgatggcggccctcatcgaatcggtaaccgtgtcggcatacataatcacggacccgttggcgttgcgggccgcccgcccaatcgtttggatcaaggagcgttcgttacgcaagaagccttccttatcggcatccaagatggccactaaagagacttcaggtatgtctagcccctcccgtaagaggttgatgccgactaaaacgtcaaacttacccagccgcaagtcgcgaatgatttgggtccgttccaaggtcttgatatctgagtgcaggtacttgacctttaagccaaggtcctttaagtaatccgataagtcttcggacatcttcttggtcaaagtggtgaccaatacccgttcgtttttttcgatccgcttgttaatctcgccaaccaggtcgtcgatttgccccatcaccggtcgtacttcaatggtcggatccaaaagccccgttggccgaataatttgttggaccacccggtcagtttgagcttcttcgtacgggcctggcgtcgccgacatgtagatgacctggtggacgtgaccctcaaactccttcagggtcaacggccggttatctaaggcgctgggcaggcggaacccgtagtcgattagctgctgtttgcgggcgcggtcaccgttatacatcccgcggacttggggcatcgtctggtgtgactcatcgacaattaacaggaagtccttggggaagaagtctaagagggtgaaggggggttcgccgggcttgcgccggtccatgtaacgggaataattttcgatcccgttggtgtaacccatctcccgcatcatttcgatgtcgtaagtcgttcgctgttggaggcgctgggcttctaagagcttgccttccttggtaaacttagcgacctggctcttcatgtcggcttcgatttccggcagggctaggtccatgatgtcttcggaggtcaaaaagtgggtggccgggaagatcgaaacgtgttcccggtcgccgattacctcgccggtcaaggcgtcaacttcgcgaatccggtcgatctcgtcaccgaagaactcaacccggatcgccttttcctcccgggaggctgggaagatttccaccacgtcgccccggacccggaagcgcccgcgttggaaatcaatgtcgttacggtcaaattggatctcaactaactcacgcaggagccggttacgagggatttcttgaccgacccgcagggaaacgacgtggttttggtattcggctggcgaacccaacccaaagatcgaggacaccgacgccaccacaatcacgtcgttgcgttcgatcaaagacgaagtcgccgagtggcggagttggtcgatttcgtcattaatggaggcgtccttttcgatgtaggtatcgctagaaggaacgtaggcctccggttgatagtaatcgtaataggaaacaaagtactccaccgcattattagggaaaaacttcttcatttccccgtacaactgaccggccaaggttttgttgtgggagagaattagggtcggacggttgacgtttttaatcacgttggaaatcgtaaaggtcttcccggtcccggtcgccccaagcagaatttgggcgtggtcaccctcttcaacccccttggtcaaggccgcaatggcctcgggctggtccccggttggttggtaatccgatacaagttgaaattctttatccggttggcgataaatcatcgtctggccccctttgttgctagcgtacaagggcccgcggtcaaaactccaccacgggcccacaattaagttaagtttagcacacgaacgtttattcgtctaattagatgacttttccttgttgacagaggggtgccccttctcttcttcgatccgttgctgccaaaggcggacgtaattaagccaggcaaactggtagctagcggccaccacgtagatgaccagggtgatgaccaggggccaccacagttttaaaatcaccagcgccccggcgacaaacatggctaggttggcaattaccgtcactaaaacgggagtctgttttttcatctctgttacctttgaataatctgggtggtgatgatggctagctgttggctgttggtggcgacgttatcctttaacagttccggcaaaatcttctttaaaaagtactgaacgctggccaggttggaaaagcccatgatcgcctccaggctggagcggtagatatccatgtaaactggctccgggttgcccttttggatctcttcaaaagattcgtacatcaggtcaatcttgtcggccaccgataaaatctgcccctccaagctctcatccttgccctcacctagccgccgttcgtaggccgcccggaactcggccgggatttcagattggatgaaattctcggttagcgaccggtcgaccttggctaacatcgtacgcaactcgggggtggcgtacttaaccggcgtcttaatatcgccgatgaagcgctcggtgtaatcgtggttaagcgccttctcgtacagggagcgccagttgatttcgttaccagcttgctcttcaatgtcgcccaacatctgggccgcttgggtcaccttaaaggagtgggcggccacgttatgttcttcaaatttaaagtagcccggtgcccggttgatcatttccaggtcgcttaggctcttaaggtattcatgcattcccatggtgattctctcttttctaaaaggtgagtggagtgggaaccaaccctaatgcaggccgtatgactaagcttagtcgaaggttgtcatggcacgtggcgttctttggcctgcttagacactaggcctgcggttggtgaccacattatctgtgtaacatagtggatttaacaaaggggcgggagaaaccagcgtttccccaaccccctcattaaaattattcatttgcaaacgcagttagggctgcttcaaagtctgccagtttttggttagcctcctggttgcttgacccggccgttccaatgtagaacttcagcttcggctcggtcccggacggccggatggcgatccaagtttcgtcggccaagacgtagcgtaagacgttcgaatttggcattcccagcttttccacggttccgtcggccaaagtcttggtatccttggcgaagtcttcggtctcttcaatcttgaccccggcaaagtcctgcggcgcttcttcacggaacttcttcatcaaagcggcgatcttggctggtccttgcaccccggcgtaagtcgttgagatcgtcttttccttgaagtaaccgtacttggtaaagagttcttgcaccccgtcaaataaagtcatttcccggctccggtagtatgcggccacttctgccaacaagaccagggtctggatggcatccttgtcgcgaacgaacggcttgatcaggtaaccgtaggattcttcaaacccaaacatgaaggtgtggttgtgcttggtttcgtattggtgaatttggtcagcaatccacttaaacccggtcaaaacattgaccatcgttaccccgtaactttgggcgatcttggtggcaaagttcgttgaaacgattgacttaacggctgccgcgttgtccggcagggtaccggcctgtttgttagcttccaagatgtagtggagcaagacggcggcaatttggttcccggtcaacaattggtactcaccgtttggttggcgaaccgcacagcccagccggtcggcatccgggtcggttgcgattaagatatcggcgtcgactttcttcccgagggccgttgcccgcacgaaggcttccggaaattccgggttcgggttctttaagcccgggaagtccccgttcggcgctgcttcttcttcaaccagctcgtagttagtgaagcccgcttgcttgagggcccgttccccgagcatccggccagtcccacacaacggggtgtagacaaacttcatgtccttgccaaatcccgtggccaagtcgctgttgaccgtaaccgtcttaacgttggccaggtaggcttggtcgacttcttcgccgattacaacctctaagccctgggccttaagttcttcttcgtcagctaattcgatgttaaagaggtcttcaatttggcggatgtagccggtcatcatgtccgattccttcggtggcatctgaccaccgtcttcaccgtagatcttgtagccgttgtattccttcgggttatggctagccgtgatcatgatcccggcgtaggtgtgcaggtgccggacggcaaaggacaattctggcgttgggcgcaggtcgtcataaatgtaggtcttgatcccctgggcccctaaaacccgggctgcttcgtgggcgaagaggcgggagttattccgggagtcgtaagagatggccaccccacgggccatcgtttcttcccccaagctggtcattaacttggccaacccggccgtggcctggcgaaccgtgtaaacgttcatccggttaatcccgggacccatcagtccccgcattccggccgttccaaaggaaagcgggccataaaaggcgtcctctttctcttggtcatcatccattgctacgagttgttctttcagcgctggttccaattggtcttggtttaaccattcttggtaggtatctttccaggtcacagcaagcatctccttatggtgtttatttcaatagttttagtataccgcactcgtgtaaggggttaaatagaagaccacgatattccggccgtcccaaaggaaagcgggccataaaaggcgtcctctttctcttggtcatcatccattgctacgagttgttctttcagcgctggttccaattggtcttggtttaaccattcttggtaggtatctttccaggtcacagcaagcatctccttatggtgtttatttcaatagttttagtataccgcactcgtgtaaggggttaaatagaagaccacgatttaatcaacgtcgccaccccgtcttcttcattagttggcaacaggacctgcgcccgttgtttaaccactgaagcggcattgccaaccgcggcggcgtgcccggcccggtttaataagggtaagtcgttttcgtcatcgccaacggccaccaccttcgcccgggaaattccggtactaacaaggtagtcaaccgcccgtcccttatcaacccccatcgccgtgatcgttaggtacccgtcaccagccgggctgatcgtcagcttaggaaaggcgcttttcaacaactgccccaacgtttgaaacatccccgggtcgctgacgatcatcaacaacatcagggcgccggccggttttaaaccatccattgctaggggaacgggaactaggcattgatcgaactcgacggccgcgtcaacaaagctaacgtgccaagccgccgcgtccatccaggtgaagttaacctccccgaagcgttcggctaccaactccaccaccgcttgggcatcccggtcatcgattggctgcgccctcaaagtctccccactggcccccgcaaaaatcagggcgccgtttaaggccgcctggggacccgtcaagcccagttggtcaatcaaaaccgtcatctgcccggggtggcgggccgacgccagcatcactcgatcggctacggccgcaaccgccgcttgggtgaccggactcagggcgccccgttcgtttaatagggtgtgatcaaggtcagaaacgaggtaattggtcatggtaagtccccctttcccaaacattttaccatcacttcgctaaaataatcgttgcactttccttttcaacgcgctatattaaaaaataattagaaaattaggcaacagtgtaaaggagatgttcaaatggcacgaaaagttgctgttgttgggatggggaacgttggtgcaaccgtcgcccactacttagtcgccggcgggtttaccgacgacctcgtcctaattgatccgcgcgaagaaaaggtggtggccgatgccgtcgactttgaagatgcgatggctaacctggaatatcacactaatatcttcgtcaacgactacgaggccctagccgacgctgacgtggtggtttccgcccttggtaacattaagctccaagataaccccgacaatgaccgctttgccgaactaccctacacccgggttcaggtcaaaaaggtcgccacaaagcttaaggaagttggcttcaacgggatcatcgtcgccatcactaacccggtcgacgtgatcacctccttataccaagaaattaccggcttgccaaagaaccacgtgatcggaaccgggacgctcttggactccgccaggatgaagcgcgccgttgccaagaagctcaacctcgacccccgctccgtggccggctacaaccttggtgaacacggtaactctcagttcaccgcttggtcaaccgtccgggtcttggggaagccaatcgagcaaatcgccgaccaaaagggcttggacctggtggacctggataaggcggcccgcgaaggtggcttcattgtttttcatggaaagaagtacaccagctacggggtggccacggccgccgttcgcctggttaacacgattctctctaacgccctaaccgaactgccggtttcaaactaccgcgaggaatacggcgtctacctttcctacccggccgtggtcgggcgcgatggaatcgtcgaacagtgccaattagacctgactgcagaagagttgcaaaagcttcaagtttccgctgacttcatcaagcaaaagtttgccgagtcgctggaagccgctgaccaagaagactaaccgttcattgaggaggaacacatttatggcaaaagaaaccgtcgctaacctggattggaaccacctgggctttgaataccacgacctgccgtacagcttcaacgaagagtttaaggatggccaatggcaaggtggtacgctgaccgaaagctccactttaaccctctcggaagccgccgaagtactccactacggccaggaagtttttgaagggctcaaggcctaccggaccaaggatggacacatcaacttattccgccccgaagaaaacgccaagcggctcgctaactctgccaagcgaatgctgatggaaccctacccggaagacaagttcgtcgaggccgttaagcaagttgttctcgccaacgaggaatttgtcccaccgtacgggacgggcggttccctctacatccggccatttttgattgggacccaacccatcgtgggggttgccccggccgacacctacaccttccacatttacgccaccccggttggtgcctacatcaacggcctcgctccttccccgtacacggtttccaactacgaccgggcggctggtgccggaactggtcaagccaagacgtccgggaactacgctagctcgctcctgccagaaattgaggccaagaaggctggctttgccgactgcctctacctcgacccacgcgaacacaagtacatcgatgaattctctggcgccaacttctttggtatcactaaggatggtcagttcgtaacgccaaagtccgactcgatcctgccatccatcaccaagaagtcgctcctagttctcgctgacgacctgggcctcaacccggttgaacgtaagatcgaaattgacaaggaactcgatgactttgctgaagccggcgcaatggggaccgccgccgtgatttcaccggtgggctccttaacttacaagggccaaaagcacgtcttctactccgaaaaagaagtcggaccggttacgaccaagctttacaacaccctttacgggatccaagaaggtgacttagaagacacccacggctggatcactcacgttaagtaatcaatggagtgggaaataacctccttggcaggtcgtatgtaagatcggacgaacggttgatgcggtacgcaccgttcttcggcctgcttaggcactagacctgcggttattttccacgttttctttctaacattcaggaataaaataagaggctgggaaaacagatttcctcagcctctttttgattgattaaaagttgtaaaggtcggttgataggtagcggtccccgccatctggggcgaccgtcacgaccttatagccggcccccagttgcttagccaactggagggagccggccacgtttgcccccgccgagatcccaatcgaaatcccttcttgttgggccaccgcttgggccgtcttgattgcctcttcgcttgaaatctcgaccaccccgtcgtagatttcctggtcgagggtggccgggataaagccggccgagatcccttgaatcttgtgcttgccaccgtgtccttccttgagtaacggtgattccgctggttccagggcgtagaccttgacctgatcatcgaccttcttgagggcccggccaaccccggtcagggtcccaccggtcccgacccccgccacaaaggcgtcggggaggttctccttgccaaaggcgttaatgatctcttggccggtcgtttgttcgtgaatggccgggttagccgggttttcaaactgcatcggcatgaagtagcccttctcgttaaccaattcggtcgccttttcaatcgagcccttcattccggcgtccccgggcgtcaggattagttcggccccgtaaccttgcatcatcttacgccgttctacagacatcgtttccggcattacgatcaccaagtgatagcccttagcggccgccaccatcgccaggccaatcccggtgtttcctgaggttggctccacaatcgtccccccgggggtgagcttaccctcttgttcagccttttcgaccatcgctagggcgatccggtccttgatcgagccagccgggtttaaggattccagcttcaggtaaacgtcggccatccctggttccactaaccggtttaacctaaccagcggggtgttaccaattaattgatcaacagaatcatagattttactcattggacatcttcctttcatcgttaactgactttacacacgcccaagaggcgcttagtggccaccatgttcaaccagtttgcaaaatagcgttgctgggtggctcgccaacgaaactttggtccttgcattcgcccctcatctttaaagtagtgcacgggtttttggtagtgacgcgtgggatgggcagccacctcacgctggtactcttctaacagggcattttgcccgtattccaggtgggcaaacaagaagctctggtacgcggttgcccgagcggctagcaagtagccctcacttgaacgcgccgttaccaccatttctggggccaactccccctcgtttagctcggcgtaacgggcgtggggggccaagaagttaggttccagcccaactaagagggggtcgggggccacgacttggttttcaaagacgccgaagtacttctttgccagccggtgtttttcaacgccgtacaggtagttggccgccaccatcgccccccagcacacgtaaagttgaaagacccgggcccggttcaaaacgtcaatcaggtcacacacctcggcgaagtactctacctggtcaaagggcaagttttcgatcggcgccccagtgatgataaaaccatccatctgggcggctagttccaggtccaagggccgggcaatcttagccaccgcctctggtaccgggcgaccagtgtagtgggtaaccgggtaaaagaaggtcagcttaaccggcaggccgggttgttcaaggacccgggtaaaacgacgcctagtcgcctccttgtcgtgcatgaggtttagcaccccaatccgcagggcctccattgccatgcccccctatccttaatcgttttcgctaatatagttgaagatttgttgaccggcgatcgccccgtcaccaactgccgttgcaatttggcgaaggacggtgttgcggacgtcaccaaccgcgtagacaccgggaacgctggtggccatcttctcgtcggtcttgacccagccccgttcgtctaagatgcccaggtccttaaaggcactggtcattggcacaacccccacgtacacgaagaccccatcagcgtcgatgtgaccatcctcgttagtctggttgttgtgggtcttgaccccggtcaccttgttatcgtcacccttaatttcggttacctcagtgttgaagatgaactccatttgtccattcttcttcgcccgttcctgggctaccatttgggccttcaagtggtcgtggcgcaccaagacggttaccttgtcggcaaactgagttaaatacatcccctcttcaacggcggagtcacccccgccgaccacgatcaggtgcttgttgcggaaaaaggccccgtcacaaacggcacagtaggaaaccccgcggccggagtattcctgttcacccggtgcgccgagcttacgttgatcggacccggtggcaatcacgaccgccttggcaatgaaggtgtcacccatgtcggtcgtcacgctcttggtgccatcttcgttgacggtcagcgccgttaccgtcccgtagccgtaagtcgccccaaactgggtcgccccgtcgtacatattctgggctaattccggcccctgaacggtcttgaagccggtgtaattttcgatcgtggcagtgttgttaaggttccccccgtaaattccgcggtccaacagtaacacggacaggttcgctcgggaagcgtacatggccgccgtcatcccccctgggccagccccaattaccactacgtcatagttcatttgcttctcttctgccatcgtgtttcctcctttaatcttcgcttggtcatatgttgattttatgatacttgctaactaaaggaaagtctaacgatttaacttactttttgttagttggatgtgaataaaaagggcgccggtcattcactcatcggcaccccatttttttaatcagctaacttagcgtaatcggcgtcggaaacttcttccaaccattccgaagagcccttggtgatggcgatgtggctaaaccaagagtccttggtggccccgtgccagtgcttaaccccttcgtgaattgccacggcatcgcccgggtgcaacttttgggccggcttaccaaattcttggtaccagccttccccagcggttaccagcagtaattggtagccgttgtgatgaacgtgccagttgttgcggcagtccggttcaaagctaacgttggccacgtgaacatcaatgttgtcatcggcggagatcaaactatttaagtaggagtcaccgataaagtacttagcaaaggcgacgttcttgtcaccaaaaccaaacaggtcgtttttaactgcttcttcgttgtttgccatcattaattcctccatttattgaactaagttaatgatagcgccgggttaattaaatgtgaaaaacctattctgactcacctttgatacccaaattgtattaattattcgccgtggccccgttgctggcgggtcgattcggccaggtgcactaagttacgcaagaagttgtgagtgtcggcttggtagccgtacttttgccccaggtcgtaaaggtaaccattgatgtagtcaacctcggtcggccggttcttgctcatgtcctggtacattgatgggtagtgaaggggattagagacggcggaaacgtagtggatcgtctcccattcctcttctcgggtcgacaggagctggatccccgcccgttctaccacgtcgtaggcctcattgattaactgtttgcccagtttttcagcggccggtgacttaatgaactgacccatctggatttcaaagagggtgcagatcgtgttgatcaccgagttaaagaccaccttggtcaacagggtaccgtagaaattatcggttaggttacagtggatgttggccttttcaaagtcggcgacaatttcttgtacccgcgggtcgtccacccgaccactttgcggggccaagttgatcgaaccggcaccagccttaccgatgaagtcaacgtcccccgccttgtttaggaccgtcccgattaaacaggtgccgccgatcacgttttctttggggaagtactggttgatcttttcgatatggcccatcccgttcatcccggagaagacgtactggtgatccggggcaaagaagtggctgctgcgctccaagaggtcttgtaaggtcatttgcttggcaaagatgattaagacgtctgggtcgccgtgatatttttccggggcgtagatgttcaccggaaccaagtgccgattttcgtggtcgcgggaaacgtagacgcccccctgctccttaatcgtgtcaacttggggctgccagttgtcaacaaagtccaccttcacacccgttaattcttgcagtaataccccgaagcgtagtcccatcgccccagcacctaaaaccgtatatgataaagccattgatttatcctcctatgtactgtgttaatcaaacaagtgtaaattgccaatccgctcgacggcctcgaccaggcgggccggttcaatcaagagcccaatccgaacgtaaccctcgccgtttttcccgaaaccgttggccggggccaccgccacggccgccttctctaacaagaggtcggcaaaggcttcggaagtgtagccggccggcgtcggcatgtaggcgtaaaaggtcccccccggaatgatcggacgccaaccgatcttttgggccgcctcaataaaggcgtcgcgccgggcctggtaacggtcaactatttcttggattgccgcatcccgccgcgggtcgatcaaggcgttaatggcggcgtattgcaaggccgggaagagtgacacaaagaggtggtcttggatcaagttgagcgcctcaatgatgtcggcattcccgaccgcaaaggccacccgccaaccagccatgttgaaggtcttggagtaggtgtaaaactcgatcccgacctccttggcacccggtgtttgcatgaaggagaccggggcctggccatcaaagccaattgccccgtaggcaaagtcggagaccacgccaacctggtattttttggcccaggctactaactcctcataaaaatcaagggtggccaccgccccggttgggttgttcgggtagttaacgtagatgaacttagcccgcttagccacctccgcgggaatcttagctaggtccggtaggaagttattttcctctaggagtgggtaagtttcaaacttgaccttgcccagtgccgcccccgataagtaatccgggtagcccgggtccggcaacaagaaggtctccccggggttcattagcgcccatggtagttcgaccaacccgatcttagaaccccccaaaatggccacttccgtttccgggtcgaagtcagccccatacttttcttggtagaagtcggctgccgccttcttaaaagcgggcagtccccggaagagggagtacttatgggtggccgggtcggcaacccacttttgggtggcggccacaatgtaatcaggggttggcttatcggggttcccctggcctaggttaattacgtccgcccccgtcgccaccttagcgttgaccttggccactaagttagcgaagaattgtttgggtaagccctgcagtagttctgattccggaaattccatgttcttgcttcctttctattcgtacaggtctgggcgccggtcattaaagacgggaatcggcccccggattgctagggcctcagccgggtcgatgtccacgtaaaagaggccctgttcctcgcccgcttcaaataaaaccttccctaacggatctatcaccattgaattcccaccaaagtgattggcggcgtcatcaccaacccggttaaccgccacgacaaagcactggttttcaatcgcccgggcctggagcaggattcgccactgatcaatccgctgaaccggccactgcgccggtaaaaagaggatttgactcccacccttagaaatcgtccgtagccactcggggaagcggaggtcgtagcagatcgcgctggcggccttcaccccgtctaatgcaaagcggttcggggcgtggccggctgaaatgaattctccttcgttcatcaggccgaacaagtgcaccttgtcgtaatcgccaaccaattgaccggttcgatcataaacgtaggtcgtgttgtagaaccgtttcccccgcttaatcgccaccgaaccgccaacgatgttaatttgattgtccctggctaaccttgctagggtctgcttagtgcgttgaccatcaaggtcggctaagtcccccagttggtcaagggcgtaaccggtattccacatttccggaatcacgattacgtccgctcccgccttagccgcctctttaacgtcagctgctacctgagcaaagttttggtctggccttgccaacgccacgtctaattgatcaattgccaccctcatttgaacacctcctaaaattaaaagcccgccccttccgtcgttttcgacgcaaaggacgggctgacgatcccgtggtaccaccttttttcacgcccccctcacagggagcacctcaatgggtcaatgacctaccggccggtaacggcgccgcaccgcccaaggcttgttccctcaccctggggctggtggtgaccatcttcaagcggggcccttttcccttccagccaccgggaaatctctggcgtagtggcgtaccgctttactcatcatcacatttgctcttaattattttatcatttgttggttagatattaatcgctttttaatctagtgtcaacccttgatggaaaataaaagagaagtgtgaaccaaccttcctcgacaggccgtgggctaagctagggcctcagttagtacccacgcactgttctttgcccgtacttagtcactaggcctgtggttgaaattggtgcaccaaaaaaggaagtgcgaaccaaacttggctccacttcctcatgatcgtttattttgctggcttcttcttgtcttcagcggcgaacttaacgcccaaatccttgatgtactcacggagttcatccttggtttccgggtgcttgaggccgtattcaatgttagtttcaatccagccaaacttgttgccgacgtcgtaacggtgacccttgtattcgtgggcaaagacccgttgcgtcttgtttaaggtgttgatggcatcagtcagttgaatttcgttacccttacccggcttggtcttggccagtacatcaaaaatttctggcgtgaagacgtagcggccgatgatggccaagtcacttggcgcatcctttggttccggcttttccacgaaggaggtaacgttgtaaagacccggcattacttccttgcttgggttgatgaccccgtacttggcggtgtcttcgtgcggcacccgcataactgctaaggttgatgcaccggtttcttcgtaagagttgattaattccttggtcaacggttcggcatcgccgttaatgttgttcaagtcgtcaccaagcattaccacgaacggttcgtcgccaatgaagtcacgggcggtcaacacggcgtcccccaaaccacgtgggtgggattggcggatgaagtagatgttaatgtcagtggtttcttgaaccagcttgagcatctcatccttgtgcttatcgcgcaggttatcttccagttctgggttagagtcgaagtggtcttcgatggagcgcttgttcttcccatcaaccaccacgatgtcttcaatcccggacttacgggcttcttcaacgatgaattgaatggttggcttgtcgacgattggtaacatttcctttgctaaggccttggtggctggcaaaaagcgcgtccctaagccggctgccggaataattgcttttcttacttgtttcatactaacttaaatccttccatgttaaattctcaatatggagccgctctcattttaccacaaatttattctttttccgaagtaacttcccgttccatcaagccgtcaatggcggacttaatgtcttcgtcttcatagatgacccggtacaaagcggcggtaattggcatctgaacgtgacgcttttgggccaactcgtaagcagctttggtagtcgctaccccttcgatgaccatccccatgttttccaccacgtcggcgagtttctggccctgaccgagttggtagccggcccgccagttccgcgagttcttagaagtggcggtcaccactaggtccccaaccccagagaggccaataaaggtcatcgggtcagcgccaaaggccaccccgagccgacggatttccgctaagccccgggtaatcaaagcggcccgggcgttatcgtggtaacctaacccgcttaaggccccggatcccagggcgatgatgttctttaaggcggccccgaactcggcgccaattacgtcgtcattagtgtaaacccggaagtagtggtttgaaaagagttcttggatctcttttgcgcacgctaagtcaccacaggctgcggtaaccgccgtcacgtccttgatggcaacgtcttcggcgtgactcggcccggacaagaccacgatcccgcggcgagaagccgccgggatttcttcggctagcatttccgaaacccgcttgtaggtattttgttctaagcccttagtggcgtgaactaacaatggtgccggcgtgacgccgtttagtagttcagccaattgaccggcaacctgacgaacccctttggtggggatcaccatcaagatgaccgctgccccactcacggccgcttgcatgtcgctagtggctactaacccttcgttgtaggtaaaatccttcatgtagtgtgggttcttgtgttcttggtttaactggtcaacttgggcttggttgcgggaccacagcattacttggtgcccattttcgacgaggaggttggccaaaacgctcccccaggatccggccccgaggacggctacttttttcatgatttctgactcccttctggtacgaataaactcgtgtaccaaggcaagtcggcttggtggcgccgacggtagataaaggtgcaaacagctacaactaagaaaattaccgatagccactgggaaacccggaggcccccgagcatcaaactatcggtccgcatcccctcaaccaccatccggacgcacgcgtaccaggatacgtaggctaagaagacctccccccgtttaaaaaggtggtggcggtggcgaagtaacattaacaaggcgaagcccactaggtcacccaacgactcgtataaaaaggtggggacccggtagtggccaccaatgtacatttgttggatgatccagttgggaaggtgttgggcgaccaaggaagcccgcgtggtaatcaccccgaaggcctcttggttcatgaagttaccccaccgcccaatcccctgggccatgattacggtcggggcaaccacgtctaatagggtccacatgttaacgtgacggtaatggcaaaagatcgccatcgtcaaaaagcccccgatgatggccccgtagatggcaattcccccatcccaaatagcgataatctcactcgggtgggcggaataatactgccactcaaaggtcacgtaataggtccgggcacaaataatggcaaccggcagggcgcacaataagtagtcataaaagacgtcttcgtttaaccccaggcgggccccctccctaattgatagccacagggccaacaccaccccgctggcaattatcaccccgtaccagtggacggtaaaagggccaaactggagggcaattggatttagggcactcagcacaagcttagtcattctccgcttcctttcggtcacgttctgagttttgctggatcaggcggttaaggttttcgtcaaaggtcttagtggcatcgtaccccatcgtctgggcacggaagttcattgccgccgattcgatgatgatggcgaggttgcgcccggtcttcaccggtactgacaccttcggaatggccacgtcttggatgaactgagtatcgccctgatcgcctaagcggtcaaactgggaatcgggcgtccagatttctaggtggacaataaagtcgatcgtgtcctgcggcaagacggcccccgatccgtacaaggtcataacgtcgatgatcccaatcccccgaatttccatcaggtgctggaggatcgccggcgccgccccaaccagggtctgttcatcgcgggcgtatacttcaacccggtcatcggcgaccagccggtggccccgacgcactaattccaatgccgtttcggacttgccgactccggagtcaccggtgattaacacccccaccccgctaatgtcgaccaagaccccgtgtaaggattcacgtggggccagtcgaccgaccaaataggaagtcatgttccccaaaattcgcgaggacgttagcggggtcctcaggattgggatgtgggccttttcggcggccgttttgagttcgtccatcaccggcaggtcggtggagaccacaaagcacggcgtttgcggggtgcacattctttcaatgtactcgcgtcgcttgtccgccggcacttccttagcaaaggaagtttcggtgattccaagcagctgaattcgcatagccgggtagtgcttaaagtaaccggcaaactctaaggacgggcgacaaatgtcactcgtggtaatctggcggttcaggtaatcttccccctgtaaaaccgttaggcgcacgttttgggccaagtcggcgacggtaactgaatcaacattgggcatgttgtttctcctccttattgattagcgaagtgattgctaataatggtgttgcaaattgacataatcagggcgatcaacatcgctgcccaaaacgaagagaaatgaatccccgggccgacgaaactcgccgtcaactgtagcatcaagccattgatgacgatcgaaaacaaaccgagggtcaaaatggtaattggtaacgataggaatactagaatcggtttaatcagggcgtttaagattgccaacacgatggccgctactagggccgtccaaacgctcgtgacgtaaaaccagccggtgttagcaaacagaccagctagggccacaaataggatggcatcgataatgatgttttttaaaaagcccactatttatcagctccccttttgacgtcttcttcctctacatcctggagttcgcgccggcttttcttggttgcttcagtcccgcggttaccccaaaagaagttatctaaggccccgttgctacttggcgccgggggcatgataatcgccgtcatcacgtagatcatggtgccgggaaccaagccggacagagcggtcaacactaggtaggcaattcgaagccaggtggcggaaattccaaagtacgtggcaaagccaccaaacacccccgccaagacgcggttggttcgggagcgggtcagcttttgatgccgtggtcgttgcataagcatccttcccttcttttgcgattatcttacttgcttttagccccgggcgcaatccatgctaccggggattcttctgggcgaggttccactgaaggtaggcgttaatgaagggatcgaggtccccgtccatcaccccgatcacatcgtgggtttcgtaaccggtccgggcgtctttgaccaacgtataggggtggaagacgtaggaacgaatctgtgacccccagccgatttccctttgttccccttcaatttgggcccgttccttggccttcttttcttcctctagttcataaagcttcgatttcagcatgttcatggcggtgatccggttttgcaactgcgaccgttccgcttgcgaggacgttacgatcccggtcggcaagtgggtaatccggaccgccgattccgttttgttaatgtgttgcccaccggccccggaagcgcggaaggtgtcgacccgcaagtcggacgggtcaatttcaacttcaatcgattcatccaggatcggcatcacgtcaaccgaagcaaaggaggtgtggcgccgggcggccgaatcaaacggtgagattcggaccagtcggtgaacccccttttcggggtgcaggtagccgtacgcattgtggcccttaattaacagggtcacactcttaatcccggcctcttcacccgcttcgtaattggccgtttccaccgcaaagccgtgctggttggcccaccgcatgtacatccgtaacagcatttcgccccaatcctgggcttcggttcccccggcaccggggtggatttctaaaatagcgtcgctttggtcgtagggcccgtcaagtaactgctccaggcgataagcccggaggtgttcttggacaccagggaagttgtcgtctagctcggcttttagctccgggtctggttcggcttggagcatttccgccgtcaaggcgagctcttcgacttggtcttgtaaggttaagaagttgtcccgacgcttttttaactcgtttaacgccgccaccttttcttgcgcccgttggttatcatcccaaaaatccggcgccgtcatttcgttttcaccctgggcaatcgattcgtttaaagcatcgaggtcaaagagacctcccgaagcgtgcaacctcagcctgcattgcttctatctgttttgtggcttcacttagttccattttttacctcaattcaaaaggcggtcgcggtaccgtttcggactgccaccgcctaattgttaacgcgttacgttttgccgaatttctgacttcatgaacagacgggtggtttcatattcaatgtctgccaccatttgttcaaacatccggtaccccgtcgtttggtattcgaccaacgggttttgctggccataacctcgcagcccaaccgactgccggaattggtccatggcgtcgatgtggtcggtccagtgggcgtcaactacccgcaaaattacgaccttttcaaattccagcatctgggagtcatcgtagagctggtgcttcttttcttcgtaaacctgttcggcaaagtccatcatcaggtcgaccatttcatccttagacttgccctcaagcattccaaccgtgatttggtccggcttaaccaagacttccaccgcaaagtcaacgatttcttggagcttccagtcctttttatcccccagggtgtgggcatcaatcgcccgctgaatcgtccgcttgaccatcggcatcaggacccacttgagcgagtcggtttcggtgatcacttgttgtcgctcgcggtagatgatttcccgctgttcgcgcatcacgtcgtcgtattgcaaaacgttcttacgggaatcgtagttgttcccttccacccgcttttgggccgattcaacctggtgggtcaggaaacgggacttgatgaccacgtcttcgtcatcgtcgtcagtttgtaaccgttgcaagaagttcttaattctgtcgcccccgaaacgcttcattaagtcgtcttctagggaaaggtagaactgtgacagccccgggtccccctgacgcccggaccgtccccgtaactggttatcgatccgccgtgattcgtgccgttcggtcccgatcaccgctaggccgccgagttctttaacccccgggcccagtttaatatcggtcccccgcccggccatgttggtggcaatcgtgacagccccaacttgaccggcgttcttgacgatttcggcttcccgggcgtggtttttggcgttcaagaccacgtggggaatcttttgttggtccaacaggtgggaaaggtattcggaggtttcaacggccaccgtcccgaccaggactggttggcccttttcgtggagagcttggatccgctttacgaccgcccggaacttgctctctaaagttgggtacaagaggtccggctcgtccacccgggccactggccggttggttggaatcgtgatcgtttccatgttgtagatttcccggaattcttccatttcggtccgcgccgtcccggtcatcccggctagcttagagtacatccggaagaggttctggtaggtgatgttggccatcgtcttgttttcttcttgaatttcgacgccttccttggcttcaatcgcctggtggaggccatcggagaagcgccggccttccattactcgcccggtaaaggagtccacgatcaggacttccccatcgttaaccacgtagtccttgtccaagagcatgatgtaattagcccgcaaggattggtccaagtggtgggtcaaggcggtgttttccgggtcgtagaggttctttaagttaaagtacttctcggcctttttgatcccctcgtcggtcaacgaaacggtctttgattccaggtcgaccttgtagtcgtcttcgttcttgagggtcttcacgaagcggtcggcctgttggtaaagctttgacgttcccgttcccggtcccgaaatgattaagggcgttctggcttcatcaatcaagattgaatccacttcgtcgacaattgcgaagttcaacccccgctgaacttggtcctccttgtaaacggccatgttgtcacgcaggtaatcgaacccgatttcactgttggtcgagtacatgatgtcgcaagcgtaggcggcccgcttttcatccggtgacttttgggccccgttgacccccacggaacaacccagccaccggtagagttgccccatttcttcggcgtcccgttcggataggtactcgttaaccgtgataacgtgaacccccttaccactcagggcgtttaagtagacgggcatcgtggcggtcagggttttcccttccccggtcttcatttcggcgatgttcccctcgtgaagaacaatcccccccatcacctgaacgtggaacgggaagagtcccaacacccgcttggcgccttcccgggcgaccgcaaaggcttccggcaagaggtgatcgaggtcctcaccatcttgaatccgttgccgaaactcgggtgttttcgcctttaattcgtcgtcggttaatttggccatttggtcttggtaactatccacccggttggccaaccggttaatccggcgtagttcccgccggtcactttcaatccactttctgagtatgttcgccatgaagcgtccctttcctttgttcacagatttggggtgtttaggccttcgccgacccctttttttatcgaaataaccttatcagctttcaattttaccatgtttgccccggcaatgaaaactaatcacgccaactaaaaaaggcgctagcacaagtgctaacacctttttgcctagttaacttcgattaaaccgtagcgcccgtcattacgccggtaaacaatgctcgtaccattggtttcggcatcttggtaaacgaagaagtcgtggcccaacatatccatctgaagaacggcttcttcagagtccattggcttcaaggggatctgcttcgtccgaacaatcttcaggctgtcgcttgcctctacttcttcactcggggtgtcaacgaattccaggttcttgtaacccttctcccgtgacttccggttaaccttcgtcttgtacttacggatttgacgttctagcttatcagtcaccagatcgacacttccgtacatgtcgttagaggtttcttccgcccgcagcgttaggtaaggcaacggaatcgttacttccaccttgtaagtacggttagagtacaccttcaggttaacgtgggcgttggcttccacgttgggttcaaggaaccgctctaacttggagatccgcttaactacgtaatcacggatggcatcagtaacttcaacgttttcaccacgaatattgaattttaacattgcacttctctcctttcagtacaagcactggcttgttctgatatcagaaggaccactcttctcatatcctatcttcattataagggatccaacctcatttaacaaacaagatccggaaatcgcttccactatctcctaattagctaacgttaccccgcaaattgtcttgcatccagccgcgcgcattagctgggccgcatggtacatagtgcgcccggtcgtgaagacatcatcgactaaaaccactgtcttcccccgcacccgttttcgatccgttaagtcaaacggttggggcgtctgtaggcgttgctcccgcgttttggccgactggggttcttgtttttcctggtccttagtcaccaacaacctttcaaaggggcactccagtaacccttcgacctggttaaagccacgcagaagctgggtcttttggtgtaagggaagcggaaccaccatttgcgccccctgttcttgtactaacttggtcaacggggcactaaaggcttggcgcaaacggtaatccccgacgaacttataggcgtgcatgaattccttcatcgcctcgttataaccaaagcaagcgcggaccgttaaaatgaaaccggcccgcacttgccactgctcacattccggacaagtcgtcgtaaaccccgggcgctgacaatacggacacccccgtcctgcctcccgggcggtgaaacgctgggaacaagtgccacatagttgcggcggcactaaccgcttaaaactgagaatatctttgaccggagggcgccacttaatcggggcgttacacaataggcagttcatttgctcaccccccgtgcccgccggttcatcgatttaatttgttgcttggcctcctcaatgcgccggctattttcctgaacccaaaaggtcacggcgccgcccggtcgctccttagaacgccccactcgaccagcaatttggactaacgccgccgtggaaaaaacctcctcgtccgcccccaagacgccgacgtcaattcccggaaaggtaaccccacgctctaaaatggtggtggtcaccaaaaaagacaactggcgctcccgcatcgcctggaccttctgaaggcgctgcggatcgctagcgtgcaccgtcataaacttaaccgcccccaagttttctttgagcgcccgggccaccggagcgaggtcggcgacgtggggcaggaacaacaaaaactcctgtcccttagtaacccgctgttttaaccaggccgaaacggcgttgggtagttttccctttgttagcttcgcccgccacttgccaaccagcacggtttgaatctggggtagcgggtggccgtggaaacgttggggcaagtaagaaaccgccaacttcttttggtgaacctgctggagcaattccttgctcggtgtggcggtgagaaaaaggagtcccccgccctctttgatcgcttggtgggcggcaaataacagggccggatccccagcaaagggaaaggcatctacctcgtcgatcaccaggttgtcaaaggcgtggtagaagcgtaataactggtgggtggtacagatggtcaactgtcggtactggtagggtgccggattcttgccgtgcaacagggcaattggtacccccgcaaaggccgcttgcaggcgcgggtagagctccaagcatacgtcgacgcgcggcgaggccaccgccacccgttcaccccgttttagtgcgccggttagtgccggaaagatcatctcggtcttcccggcacccgtgaccgcccataatagccggtgctggtgggccgccatcccggccggcccctcactcgctacccgctcttgcagcgggctcagttgcccctgccaggtgcacgggttagtgggcggggtaaattgatttggttcggctaagtgataaaatcgatcatgacttgtcacccgccccaaattcaggcacactggacagtaataggccccacttggtaagcgaacccgttccttaattaagcgggcgttacaccggcggcaggtaacccagcgtccccgttcatccatcgccttttcccccgttaacccaaatggagcgggcaaggcttggttaattaaaacccggcgcccgtataattcttctttttgcatggtttttcccccttaccattaaatacggggaaagtgcttttagtaacgtaaggaggcccttttttggcagcacaatatttgaccatccaccaaaacacggaattcgaattagtcatcaaaaaatcccgcttcatctgtagcctagcccgggtacacagtgaacaagaagcccaagacttcatcacccgcatcagcaaggaaaaccgcaaggctaaccataactgctacgcctacctgctcggcgataacgatcagatccagcgggaaagtgataacggtgaacccagtggcacggccggtgtccccatcttagaggccctccagctcgcccacgtccacgacgtctgtgccgtggtcacccgctacttcggtggaattaagttgggcgccggcgggttaatccgtgcctattccaacgtcaccaccgaggcaattgcccaggccggcttggttgagcgaatcacccagcaggtggtcgccatcactgttccctaccgcctcaacgatcaggtccactactacttagaacaggcggggttggccctggctggggaggaatatggcgttgacgtcaccatccgggtcttcatcaacctagaagaagtcgacgaacaaatccaaaccctcaccgaccgcttcaaccaccaactccaaattaaaaaggaggaccaacgttttcacgaggtccccttaaataattagcaggaaacaaccctctcggcaggtcttctgactaatcctagccgaataggtggtgcgaaatgtaccgttcttcagcctgcttaaacactaggccggcggttatttaccacgttttctgtctaacattcgagaatacaacaagagaggctaggagaaaacagtgtttctcctggcctcttgttgtactgccacttttttatataaactgctccaccaagttcagtgccaccaagagaacgcagagcaccgctaaggtgatggtaacgtggcgcacccggcggtcatgttcccgccaggcttcgtagtgggtactaacgtaagcacccaccaatagaatactcccgagcaccccgtaaattcccgagtgaaagtgctcttgttgaatcgtaaaggacatcattaagataatccccaccagtcccgtaaccacggttataatttttcgtttcataagtgcatccatttcccgggaaatattcccgttaagggggaatgggaaacaactggttggcaggtcgttaggttaagctagggggaggttagcgcggaacgcggtgttcttcacccatacttagccactaggccgacggttatttcccacgttatctgtgtaaaattcaaaaatcaaaaaggggccggaagaactctaattctcccctcccccatcaattattcatgcaaatgatagttgtaagttgaaacaatgatgttttcccgcgaattcagcagggttcgcaagcgtaggctcgtttggttgtgcaaagccatttgccacgggtgctttggaacgaactgcggaaccaatacggtagtcgaataattcttatcggccgcccgcttggcgatcacgtctacgaaccgtaacgttggcgtggcaatcgagcggtaggacgagtgaatatcaacgaaacgcacgtccgggaactcggccttaaattcgttggccgtcttatgttccttacccgggttttcatcaaaggacacgtgcatggcgatgacgtaatccccaattgaacgggcgtaattaatggcgcccatggtgacccgtgtcacgttcccgactaaaacaatcacggtggccccgtcgtaatcatgcaactgaaccttagccttttccgctacccgcagttgcatccccaccttgatgtagtgggtgtgaatgacgtggaacaggtacaagagggccggcatgatgatcaggtacggccacacgttggagaagtgttgccagaacaagaagatcacgagggctagtgagattaacgcccccaccaggttaatggttgacttaaccagccaattcccttcctttaagcggaaccagtggataatcatcccggactgcgagagggtaaacggtacgaacaccccgacggcgtagagcgggatcaataggttggtcttcccgtggaaaaggatgatcaacacgatcgccccgaccgccagggaaataatcccgttggaatagcctagccggtccccacggtccataaaggcgtgcgggaggtacttatccttggccatgttgaaggccaaaattggaaaggccgagaacccagtgttagccgccacggctaagatcatcgccgtcgacagttgcaagaggtagtaacctaggccctcgccaccaaaaacggccgccccaatctgggacaagacggtgtggtgcgggttcggtacaattcccaggtaaaaggacaggaaggtcaccccaccgaagaaggccgctaagatcaggctcatcattgccaaggtgttggcggcgtttttcttcttaggagggttaaagttcggtacggcattggagatcgcctcgacaccggtcaaagaagatgacccggccgaaaaagcccggatgaacaggatggcagacatcccggctaccggcgtcccgtaattggccgtggcgtggtaagccacgtgaccggtagcgatgttatagccaccccagacgatcatcaccgtcatcatgattatgaaaaaatagaccggaatggtcaggaagttagcactctcactcatcccccgtaggttcatgaacatgatgatcaagacaatcaccactgaaatatggaccgaataattatatagggaaggaattgcagacgtgatcgcttccgtccccgacgtcgttgataccgccaccgtcaacatgtagtcgactagcagcgagcccccggcgattaggcccccgttgctcccccagtttttggtggcgacaacgtaggcgcccccaccgctcggataagcgtggatgatttgccggtaagacaaggtaattgctaacaacagaactaaaacaatgccggcaatcggtaaggaataccagatggcggccgtcgaaagggttactaaaaccgtggtaatctgttcggtaccgtaggccactgacgaaagggcgtcggacgaaagcatggccaaagccttaaacttcgtcaagtgcgactggccctcgtcaagcgtctttaatggtttcccgatcaagacacgtttaagatagcgccacataaaatttgtctcctcttaaaaataagtcaacagctattctacaccccgggtgaaccgaataccaccgtttctacgcaaaaaaggtgggtgcccgaagccacagctccgggcactcacctcccaaaaaattaattttcaaattacatcatgccgcccataccaccggctactggtgcttgtggtgcagcgtcagcgggttgtggcttgtcggcaacaacggcttccgtcgtcaagaggagggcggaaacggaagctgcgttttgcagggccgagcgggtgaccttcgttgggtcaacaattccggcagcgaccatgtcttcaaacttgtcatcagcggcgttgtaaccaactcccggcttttcttgcttcagctggttaacgatcacggaaccttccaaaccggcgttttcggcgatttgacgaactggggcttccagagccgccttcacaatcttaatcccggttgcttcgtcgccagttgcggatgcttccacttcgtccaaggcagggataacgttaaccagtgccgttccaccaccaggaacaaagccttcttgcacggcggcccgggtggcgtttaaggcatcttcgatccggtacttcttttccttgagttcggtttcggtagcggccccaaccttaacaacggccaccccaccggctaacttagcgagccgttcttggagcttttccttgtcaaagtcagaggtcgtttcggcaatcgccttcttgatttggtcaacccgttctgcaatggcttccttgttgccactgccatcaacgatcgtggtagcgtccttggttatcgtaaccttgttagcagaaccaagttggtcaatcgtagcgtccttcaattgcataccaaggtcgtcggaaatcacggtcccaccagtcagaacggcgatgtcttccaattgagccttgcgacggtcaccaaagcctggggccttaacggcaactacgttgaaggttccccgaatcttgttcaacacaagggttggcagtgcttcaccagtgatgtcatcagcaatgattaacagggcgcgcccttcttgaacaacagattggagtagtggcaagatgtcttgaatgttagagatcttcttgtccgtaatcaaaacgtacgggttgtccaggttggcttccatcttgtcgttgtcggttaccatgtattgggacatgtaaccacggtcaaagctcatcccttcaaccacgtcaacgctagtatcaaccccacgggaatcttcaatcgtgatgaccccgtcgttaccaaccttttccatggcgtcggcgatcaacttaccaacttccttgttagcagcggaaatggaggcgatttgagcgatgtcgtccttggtcttaacgtcgtggctcatctttttcaggccttcaacggctgcggccgtcgccttttcaatcccgcgccgaatgcccactgggttagcgccggcggtcacgttcttcattccttcggtcacaattgcttgggttaaaacagtggccgtcgtggtcccgtccccggcaatgtcgttagtcttagaagcaacttcggaaaccagcttagcccccatgttttcgaagtggtcttctaattcaatgctcttagcgatcgttaccccgtcgttagtgatcgtcggggagccgtaactttgttccaacaccacgttacgtccctttggcccaatcgtcgtcttgacggtgtctgctaacttatcaaccccacgcagcattgcgctccgtgcgtcttctgagaactttaattcctttgccatctttatctcacctcattgaatttcttagtcaacaaccgcaactaaatccttttcgtggacaaccaggtaggtttcaccatcgtattccacttcgttgccggcgtacttgtcaaacaagaccttgtcgccttccttaacggcgaccgccaccacttggccattatccagcgtgcgaccttgtccaacggccactaccaccccagtggttggcttgttcttagcgttggaggctaaaacaatccccccaacggtttgttcttcttcttgcgcctttaaaatgacacgatctcctaatggttttaacatggttatccctccattatttcaagtcaatgattagtggttagcacggggacgagcactctgctagcactcaaccccctcaagtgctaattacatattctaatataacacctttcccccggaatgcaaccaaaaactttgactaattttgaccaaacaaaaaagaggctgggaattcccagcctccttgctgtatatccgaatgttagacagaaaacgtggccaatcaccgcaggtctagtgcctaagcaggccgaagaacgatgcgctcttacatccgacccgcagcggaagttattttccactctcttcggattaatcttcgtcgtcggtcgtaaccttgttgctttcaatgaagtagatcagtgtttgcaactcattggttaaatcgatgttttgaacctgcacgtcctttggcacggacaggcggactggcgtaaagttcaggatcccgtgaaccccggcttcaaccagttggtcggtgaccgcttgcgattccgaacccggcaccgtcaaaataacggcgtcgatttgttgctccttaatctgttttttcatgtcttcaaccgggtaaaccggaatcccgctcttgaccgtgttcgccagggattccttagggtcaaaggccgctgaaatccgcaggttggtgctctggtggaagttgtagttcatcagggccgaccctagggaaccgacccccactagggcgacgctggttaacttgtcttgcttcaagatccccttgaaaaagttcaacaacttttcgacgtcgtagccgtacccccgctttccgagctcaccgaagtaggaaaagtcccgccggatcgtggcagagtccacctgaactgcttcggaaagttccgtcgacgacacccggtgcttattagcgttcaataaaacgtttaggtaccggtaataaacgggtaagcgcttagccgtggcacggggaattttacgatttggcataataattcctccatttctttgattgtgaaatattattccttactcattctaacaacctctagtttgtttgtgaactaacattcattactttttggttattttttcggttttaagataaactatgctacactttgaagtagctaaaataggaaaaggatctccactcatgttgttacttcaaactaacgatgtcctccgccggtttggcgccgacgtcttatttcacaatattaacctccaggtcgttgatcatgcccgcgtcgccctcgttggccgtaacggagctgggaagacgaccctcttaaagatgattgccgggatcacccagcccgacgagggaaccatcaccaaggccaagggactttccattggctacctagcccaggatcagggccttgacagccagaactcgatctgggcggaattagacaccgtctttggtcccctccacaaaatggaagctgaaattcaccacttagaagggcagttggcaacggttgattcaaccaccgaccgctaccaagaaatcttaagggattacgaccgcctgcaagagcagttccaagaggcggggggctttgagattgactcccggatgcgcggcgttttgaccggttttggctttgaagaagaaagctaccaacgccccgtcaactccttatccgggggacaaaaaaccaagctggctctagccaagatccttttacaagccccccagctactgatcttagacgaaccgaccaaccacttggacatgggggtgttaacctggttagaagactacttaaagggctactcgggcgcccttttaattgtctcccacgaccgttacttcttagaccgggtggtcaacgaagtgtacgacctcgataaccaaaccctccaccactacacgggaaactactcggccttcgttaaaaacaagaccgcccgcttggcaacggaaatgaagcattacgaacaacaacaaaaagagattgccaagcttgaggacttcgttaataagaacctagtgcgggcctccaccaccaagcgcgcccaagctcggcgccgccaattagaaaaaatggaacgcatggaacgcccccaaaccgatgacaagtccatccacttctcctttagctcccaaaaggagagtggcaacgaggtcctagacgtcgaaggcctcaaaattggctaccaagacaccgttttagctggtcccctcacctttaacgaacgcaagggccaacgcatcgggatcattggccccaacgggatcggtaagtcaaccctgttaaagacactgctaaaaaagatgccggcgatcgcggggacgattaagttcggcgctaacctagacattggttactacgaccaggaacaacagcagcttcacccggaaaagacggtcttagacgaggtctgggacgaccaccccgaaattgatgaaacccagatccgcaaccttttgggctcctttttattcgttggtgacgacgtctacaaacacgtcagcgacctgtcagggggacaaaaggcccgtttggagctgactaagctctcctttgaaccgattaacttcttgatccttgacgaaccgactaaccacttggacattgacagtcgcgaggtcttagaaggggcgattaacgattttgacggtaccgtcctcttcatttcccacgaccgctacttcatcaaccaggtagctaccgatgttttagcaatgcaaaaagacggcattacccgctaccagggggattacgatgattacctacgggcggtcaccgaacaagaacaagccagcgccgacgattcaaccaccccggaccaaaaaagggcccccaaggctggttccgctgcccaacagtcctaccaacaaagcaaagaagcccaaaaggcccgccgtaagttgcaacggaccgttgctgaccttgaagaacagatgaaccagttgggcgaacaacaagagcaagttgaaacccagatggccgacccggacgtggcgaccgacatcggcaaactgaccgacctgcaaaaagagctcgacgccctgacaaagcaactagaagacgtcgaagaacaatggaccgcggccgccgaacggctagaagaatttgataactaaattaaaacgaggctaagagctaacaaactactcttaacctcgtttttaattttcggctgttaattggttatccttggtctcgcgtctaagtgtggcctgcaaggcaatcctccttagaagttgaccttagtaacctccccggaagagaaggttcttagctgaccattaggcgccctaaccactagttggccttggtcatcaatgttttgggcgattccgctaaaggtcgtttgcccaatttgaaggcttaccgaccgccccaaaatcaaggagtgtgcccggtactccggtaaaaagatcccttgggaatagtcggggaggtcgcttaggactgcttcgatcaactccgcagctagacggttacgatcaaccgtggccgccgggtcaattccggttaccttttcttttaagtcagccggaaattccttagtggtcaagttaatgccaatcccaattaccaaagaggtctggctagtggcttccaggtcggtttgcatttccgttaaaatccccactaccttttggtgtcccaagtacaggtcattgacccacttgtaactcagtctttgggcggggaaaaaccgttttaagacggttgccaccgttacggccactccggtcgttaacaagcctggttgcccaggaaaggtaacgtttggaaccccaatcgtcatataaaggcccgtggctttcggggcataaaaggcccggccccgcctcccgtaggccccgatttggtggtcagcaatcacaacgaggggggcggtcgaatctcccgttgctagtagttgccgggccgtggtttgggttgattcgagttcctcttccaccactagttttaccttcgtggtgcctaggcccagttcaattacgggtgccaacattttagcagtcccccggtaacaataaccccgtttgcggtccgaatcaatttggtagccggcctgttggagggaacgaattgccttccaaaccgactcccggctaacgcctaattggtcggctaggctctgaccggaaaaccactggtttggcgctgaaagtaagtgggctaatagccgttctttggtcgccattaacgccaccccacccggtggagctgttggctaatcgttacgcacaagatggccttcaacaagtcccccggcatgtagacgacgctcccaatcagggcagccttgaagctaatgtgggtaatgaagactaacccaattgaacccgctaagttgatgaagagtaccccaccgattaaaacggcgaagaactcccataaccaagatgggttggccttgaggttcatgatcgatgcgatgatcgccggggccaagagccagccaacaaagtaacccgctgaggcactgaagaagacggcgaccccgccggcaccaccggttaaaaatggcatcccaacggccaccaggataaagaaacaaaccatgaccaaggtccccttcttggcccccaataattcacccgccagcatgatcccggcgttttgcaacacaatcggggccggcaaaatacccactgggatccccgggaagaaggctaaaacaataattacggctaggaccatcccggcccgggttaattcagttatacgtgtacgactttgcgtcatcgatttttcatcctttctcttttgtaaccctaaaaaatccaagagggttacaatcatgccatgaaaaagtcccccgcaagggactaattgaataattgcgaataaatattaaattaagtggacacctttgtcaacgtaaattacgtcaccggtcaccccggtggacagatcgctcattaagaaggtggcggtgccgcccacctcttcgatcgtaacatccttgccatcgacggtccgggccttcgacatggccaataattcaccatgtccttgaatccccgtcaccgctaaggtcttcagggcgccagccgaaatggcgttgacccgcaccccatttttacccatgtcacgcgctaaatagcggacgttggcctctagagccgccttggctacccccatcacgttatagttagggatcgcccgttcggccccaaagtacgacatcgtgaccacgctagctgggttctttagcaacggggctgcggcccggcaaacggcgattaaggagtaggccgaaacgtcttgggccagggcgtaaccctcgcgtgaaacgtcggtcatttccccacctagttcagccgggttggcaaaggcaacggaatgaaccaccccgtccagttggccgaattgttcaccaatctgttgaaaggcccgttgaatgctttcatcactggccacgtcacattgaatcatccggtcggccttttcttcgcccactagcttagtcaggcgctttaaggtccgttcccggttgtaggtgtaaattaccgtagccccttgcttttccatttcctggacacaaccccaagcaatcgaacgacggttggcaacccccatcaccacaatcgtcttgttcgctaataatccttccatgagtctgtttaatccccctaaaactttctgtatcgtgcccggcgccgcttgaggagttcctcgggcgtcagctgggccagcgttgcaagttgtttttctaagacaacatcaatgttttgaatggttgcttggtgatcagttgtttcttcgatgatcccttcaatcaccccttgttcaaggagtgcctggggggtcatcttcatgacggcggccgcttccggtgcccgactactatccttccacaggatcgaagcaaaaccctccggcgaaaggacggagtaggtgctcttttctagcatccagatctcatcgccacaggccagggctaaggcgcccccactgcccccttccccgtagatcagggtgatcagtggggtcttagcctgactaatcttgagcaggttttgggcaattgccgatccttgcccctgttcttcggcggattggcccgggtaggctcccgccgtgttgaccaaggcaatcaccggccggtggaacttagcggcgttttcaattaagcgcagggccttccggtagccaccaggtgccgggctcccaaagtgcttggcaacccgttgaccaaccgtcttcccacggtcggtggtgatcaccgtaactgggcggccgtgataggtggctagccccccaatgatcgccgggtcatcggtcccgttgcggtccccgtgcagctcaaagaagttatcaaagagttggttgatgatctctagccccgtcaccttcccggcgctacgggcggcttgaacaatggcataagcgttttccttagtcattttgcttccccccgtacttcattaaccaggctaaggtcgtcttttcatcctggcgggtaacgatgtgatcgatgaaaccgtgctttaagacgttttcggcatcctgtaagtcggccgggatttccgtgtgcgtggtttgttcgatcacccggcggccggcaaagccaactaaggcccgcggttcagccaaaattacgtccccctccatggcaaaactggccgtcaccccacccgtggttgggtcggttaagaccacaatgtacagcaagccggcggcatcgtgttcagcaatcgccgttgaaaccttggccatctgcatcaaggacataatcccctcttgcatccgggcccctccggaggcggtgaagaggacgaccggacgctggtttttcgtggcgtcttcaaacaggcgggtaatcttttcgccggtaatcgtccccaaggaacccataataaaggtcgggtccatgatccctaagttaaagtcaacgtcaccaatccgggcacggccggtccaaaccgaatcattgaggccggacttttcctgggcctttttcaatttcccctcataacccgggaaatttaaggggtcttgagtttgtaaagccgtgtccattggcaccgcggaatccaccagccaactcagccgctggttagcactaatccgaaacccgtacccgcagcccgggcacgtagcgtactcatccatctgggcggcaaataaggtccgctggcactttggacaggtccgccacaggtcatcggggaccttggcgtcggccgttcggtcagcttgaacgtggcgctcactaagggtgtttttcgccttgtagagtttcacttgccaattcccccttccagcgtggcaaaaattcttgttctaagtagttagtcgtaaaggtggcttcattaaagaccggatcgtttagaatcgccaggtggaaattctggttggtcgtgatcccggtaattaccatttcatttaacaaccgcctcaggcgcgaaatggcctcctgacggtcgttaccatgggcaattaccttcgccaccatcgagtcataatatgggctgacggttacccccgggtacaaggcggtgtcgattcgcatcccgaggttaccaactggtaggtataagtaagtgaccttcccggttgacgggaaaaagccccgctttggatcctcagcattgatccggcattcgatggcgaccccttgggccttgatgtcagcttgggcaaacggtagggcttccccagccgccaccactagttgcgccttgactaggtcaattcccgtcaccatttccgtaaccgtgtgctcaacttggatccgggtgttcatttccatgaagtagaagttctggtcctggtccatcaagaattccagggtcccagtgttgaggtaatcaattccgttgacggcccgcacggcgatctcacctaactcacgccgcttatcttctgaaattaacgagcacgggctttcttcgatcaccttttgcttattacgctgcagggaacagtcacgttccgggaagtaaacggcattaccaaagcgatcacggaatacctgtacctcaatgtgcttaacgttttccatgatcttttccaggtacatccggtcgtcgttaaaggatacccgtgcctcagcctgggcctcactaaaggccttctccaagtcgctggcctgttcgatctttcggatccccttgccaccaccaccggcagcggccttcagcaaaatcgggtaaccaatcttgttggccaccgctagggcagtctgggcatcttgaacgtacccatccgaccccggaatcaccggcacacccgccttttgcatttgctctctggcgtgctctttattccccatcaaatcaatcgtggcggccttgggaccgataaaggtaatcccgacggcatcacacatttgggcaaaggtggcgttttcggacaggaaaccaaagccggggtgaatcgcctgggccccggttccaatggcggcggccaggatgtttttcatattgaggtaggagtcttgcgggcggggcccccccacacacaccgcttcatcagcaagctgaacgtgaaggctgtcgcggtcagcggtcgaataaatcgccaccgctttgattccctgttccctcaaggaacggataatgcggaccgcaatttccccccggttagctactaaaaccttcgcaaacattcttctcttcccctatctatttagtcaatgaagaaggtcagttccgccgtgcaagctcgcttgccatcgacggttgccactcccttgcccaggccaatgtggccgcggaccttttccaagtggacctctaacctcatagtatcgccggggcgtaccaccttccgaaattcagcggattcgatcccgccgaagtaggccgtcttgcccttgaaatcctcttgggataagagggccaccgccccagtttgggccagtgattccacgattaaggctcccggtaacaccgggttgtttgggaagtggccgttaaagaccgcttcgttgatcgtgacgttgcgcttggcaaccgccatttcccccggcaccaattcttcgacccggtcgatcaaaagcattgggtagcggtgcgggataatcttttgaattgccgtactatcaagcattaccttactcatcgttagtcctccttgagggtgatcaggggttgttctacttcaactaactccccgtctttaacgttgatcgcactcacgatccccgcgtgatcactcttgatttcggtcatcatcttcattgcttcgattacgcaaaccacgtcgccttcttcaacccggtcgccaaccttaacaaaggccgggacccccggtttcggttgtaagtagacggtccccactaacggggccttcacactaacccccggtgcctcctttgcgacgggagctggggcttgtggttccgccggcgccgcagctggggccggggctgcttgaaccggggcctcaacgggggcgtggtgcttatttttactcaggtaaaggtggaagtccccgtcgtcaagcttaaactcgcgactgtcggattcttcaaacaccttcatcagcttctctaaatccttgagttccatccttaatcatcctcccacttcttgaaggtcagcacagcgttgtgacccccaaagccaaaggaattactgatggcaaagcgtgcttgtggtgctgcttgattttctgcggttaccaaggtgactgggcaatcaggatcttggttatcgcaaccaacgttagctggtaactttccttgttctaaggcagcgaccgtcaaaacggcttcgattgccccggcagcccctaagaggtgtccggtcatccccttggtcgaagaaaccttaacttcggaaccttcgccaaagaccgtttgaatggcgtgcgcttcaccagagtcgttggcgtgggtagccgtcccgtgagcgttaacgtatgcgacttcggctggcgtaattccggcttcgtcaatcgcctgttgcatagcccgcgcggcgcccttccccgtaggatccggtgaggtgatgtggtaggcatcccccgtcgccccgtaaccaacaatttcaccgaggatctttgccccacgagccttggcgtgttcgaggctttcgagcaccatggcggcgcccccttcacccagcacaaacccgttgcgatcaacatcaaacggcttggaggccttcagtggatcttcggtcgttgacaaagcagtcagggccgcaaacccggcaatcccgatttcgttaacggaggcttcactccccccagtgatcattacctgggctcgaccttccttgacttgacggtatgcatcaccaatcgcgttcgtcccggaagcacatgccgttaccaccgccgagcacatgttttgggcgttgaagcgaatcgcaatgttaccggccgccatgttggaaatagccatcggaacaaacattggcgaaacccgctttggtcctttatcgtgcatcttaatgatttgttcttggatcgtggttaagcccccgatcccagacccaaagatcacccccatgtcctctggggcggtgttatcttcgttgattccggccatgtcaacggcttcttgggccgtttgaatggcgtattgggagtagaggtccatccgccgggcgtttttcttgccgactacttcagcgggatcgaaatcatcaatttgacctgcaaccgcaatcccggtctcttcggcatcaaacttagtgatcttcttgatcccgacctggccggccagactgttttctacgaaggcggttaagccgtttccgttcggggcaatggcgcccattcccgtgattactacgcgtgtcatcttgtgttcctcctaaatcgtcatcccaccgtcaacgaccaatacttggccggtaacgtaatcattttgcgccaagaagattgcgcattgtgccacttcatcgaccgttcctagtcgcttaagcggaatttgttccacgatgccctcttgaacccgttcggaaagggcggccgtcatgtcgctagcaatcatcccgggtgcaatggcgttgcaacgaattccccgcatggccccttcacgagccaccgtcttggttaagccaacgatgccggccttacttgccgagtagttggcctgcccggcattaccgtgtaatccaactacgctagccaggttgataatggcaccagagcgttgcttgttaaacttcttgatcaaggccttaatcagtaaaaacggtccccgcaagttaacggcgatcacctggtcaaagtctgctaccttcattccgccaatcagacggtcgcgggtgatcccggcgttattaaccaagacgtcgatgtgcccgtaggcatcccaagcctccttggctaattgagccaccgattcttcatcagctacgtcaccaatcaagaacttgtaatcggcgccagctgcttctagcttttgcttcatatcatcatcgaggtcgtggcgcccgtttaacaccaagcggctcccctgcttagcaaaggccagggcggttgccgccccaattccccgggttgaaccggtaataaagacaaccttatccttgagttccatcagaaacctccttaacaaaggcctggtaatcggccaggctactgatccggtagcgggtcagcttgcgatcaacttgcttagcaaagcgggtgagggtcttgcccggcccaatttccaaggtcgtatcaaccccttggtggttaatcaggtaggctaagtcgtcaccaaagtgagttggcactgccagttgccgggccaagacgtcagccagtccctccttttcaaacggggtcacggtggtgttagaaatcaccggcaccgttggcgtgtggaaggcgacggtctttaagcgctccgtcatcttctggcgcgcaccgttaaagaacggggtgtgaaaggccccggagacctttaagacaacggcttttttcgccgcttccttagccgtgatttcttcaaccacttgttccaaggcttccttagccccccctaaaaccacctgatccggggagttgtagttagcaaagtaaactccttgcccagcagcttgtgcagcttcaaccgcttggctgaccacgtccaacttgggctcaacaatcgccgcaagggtggacgggacttggtcggcatcttcttgcatgtagcgggcccggtcggctaacaaggccattcccggtgtaaagtctagcgccccagccgccatcaaagcggcgtattcacccagtgacaatccgaccatcccggcaatcggtaactgcaggtcgcgttccaacatccggtaaatcccataagaaaccgtcaccagggctggttgaacgtacttggtgtaatcaagttcgcccccctcacccttcatcagggtggcgatatcgagaccggtggcttgactcgcttcttctaccaattgacaaaagagggggtcgcccaaaaagtcgacccccatcccaggtttctgggcgccctgcccgctaaaaagaaccccgatttgcattaggcgtccttttcgtccagttgcttcttaacaaagtcaaccacgtcgccgatcgtttcgatcccttcttcaacgtctaattggatgtcgaacttgtcttccagttcgttcatgatttcaaacacgtccaggctgtcggcttccaggtcgtccttgatcttagcgtccaaggttacttggtcttcgtcaacgtccaattcttcaacaacaacgttcttaacagtttcaaatacttcttccttagtcatggtaaattttcctcactttaattttaatttagtatcttaagattagggttccaacggtcagtccaccgccgaaaccgcttagggccaccaggtcgccccgacgtaggtgacctttttgaacttcttcggcaaataaaattggctcgctggccgccgacgtgttcccgtattcgttgatgttaacgggaaaccgttggcgatccagttgcaaacgcttcgccacttgatcgataatccgggcgttggcttggtgcaacaagaaggcgtcaatatcttcaatggttaccccggcctgttgggctgctaaccgaattgaagtgggcacctcatgagtggcaaaccggtaaacggcccgcccattcatcgtaaagggagcgaccttcgttaccggtcccgggaaggacgttaatggcgtcgtttgcccggcactcagttggtcggcttggtcgccaaaggtggctaggtgctcgcccaacacgtgggagggcccggtagtttcttgttccaccagcaccccgccggccccgtcgccaaacagaaccgccgtggttcggtcttgccaatcaatcagcttggataagacctcgctaccgatcactagggcccgctgaccagggtttaataaccgctcaaccgtgtggagggcgtaaacaaagcccgaacacgccgctgacaggtcaaaggccaccgccttggttgccccaatttgtccctggacaattgccgccgttgacggggtgtaactgtcgggtgacatggtggccaccacgatcagggccacttgttccgcggctagccccgcctttgctaaaagctggttagctacgttaaccgccaagtcagaggtggtctctccttggctgatgtgacgctgcttaatccccgtacgggtggtaatccattcgtcgctggtgtccatcaactggctcaactcatcgttagtgaccacccgggtgggaacgtaacttgcggtttcaagtatccgcatggctattttcctttcttctagaatcaggatttttcatctaaaaaggcctcgaggttcatcaaggaacggcggatcacccgtttttgttcctcatcggtccccttcaaaaaactcttcaccatcatgttgtgaaaggcccggtgggagcggtacaaaacccgcccccgtttagttaagcccaagcggattacccggcgatcatgctcgtctcgaaaccgttgcacgtaccccttgcgaaccaggcggtcagtggtggcggtcatggtacccggcgacaggtggagttttttggccacctgcgaggccgtttggtggttatacatcgagatcgcatcaatggcgtgcatctccttgatggtcaagtccgagaaggcggatttcctgagttcatgttcttcaatccacatgatcccgttgtaaacccgcaccaaggcctgattgatttcccggtagtcgtcatccataatgcatttctcctctcgttattctagcaattcaaataatttgaatatcaaaatacattataaacgaatttgctcctagagtttctcctctcgctccgccacgataaaggtcagctctgcgctacaaacccgccggtcgtcaaccgtcgcaacggccttcacaattcccatgcgcgagcgaaccttctccatgtcgatgtggagctttaagacgtcccccggccgaaccatcccgcgaaactttgctttgcggacccggcccaggtaggccgtcttcttataaaagtcgggcgacttgaggatcaagaccgaagccgcctgggccagggtttcaataattaaaacccctggcatcaccgggttgcccgggaagtgaccccgaaagaatgactcgttgatcgtcacgtttttcgtgcagacgatcgacttgcctggttccatttcgtcaaccgcgtcgatgtaacaaatcgggtagcggtttggaatcagatccatcacctcttgcgctgtcatcagtgccaattttgtcacctaccttgtcgaaaagtatttcgagtatcaaaagattcgatagtggaattatattcaatgtcttttgcactgtcaaaccatcttcggcatttttaattctcccgaccccaacaaaggtaatagtttgatccttcaaactatcttgtttcagagccaatttgacgcgatcggttatccatgaacttttattcatttcactagaaaacgacccgctaaattttttcatttttgtttcgactatcaaagtattcttcactgtttttgccatcacaaaaagttcacgatttccctaattgaatccccacggggcccagagtagaataaagtgaaatttgggaggattaaaatgaaaaaaccactttcctattcgctgatcacccttttgatcattgggctaatcagcggaattgggtggcacggcttaaccacggccaccaaccggaccaccactagccaaaccaccagctccgaatccaaagacacaagttccagcactaagcaacggagcgccgaatcatcgtcagccacttcttctaacgcctccgcttcttcgtctaattcggcttcccccaccacccaaataacggtcgcttccacgggcaatcaccgttggcaaggcccccgggttatttcaaaggaggccgccatcaaggtggcctcccacaaactaggtaccaacggcggagactggacctgggagtgcgtcagctacgatggttacgcctaccgcctgcaagcaacctcccaaaaagcggttaataacggcgcccccaatcccattgccctaaccgttgtcgtttaccacgatggctcactagaggtaaactaggcactattaaaaaagctggcgagcaccgtttgaaacggtgctcgccagcttttatttaccacgttttctgtctaacattcgtggctacagtaaggggccgggaaaaacgatttttccctggccccttaattgcccttagttttcttctttcaggtgggcaaaggacaagcctggcacggcgtttaaggaaccatcggcccgatccccgtgtaagtagttaacgtagccggccgccccgatcatggcggcgttatctccacaatacttgagcggggcctgaagtaattgcacctcgggatgcttggcttgtagaccggcgcttagctgctttctgagcccctgattagcggcgacccccccggccaagatcagttgcttaaccgggaattcatctaacgcccgaatggttttggcgactaagacgtcaacgacactctgctggaaactcgccgccaggtcatatttatccagaacttcgccccgttggtcggcgttatgaaccgtgttgataaaggccgatttaaggccagaaaaggagaaatcaaagttatcctctttttccatcgcccgcggaaagtggaaggtgtcatgccccttggctgcccactgatcgacggttttcccggccggataattgatccccatcacccggcccaccttatcgtaggcctcaccagcggcgtcatcgcgggtttcaccaatgatttggtaatcgtgctcttctttcatgtagaccagctccgtgtgaccaccggaaaccaacaacccaagcatcgggtaggtaaagtcactcacgaaccgtgccgcgtacaagtgaccggccatgtggttgaccggcacaagcggtagttggtgggcccatgcgatcgtcttagcggccgtcaccccaatcaaaagggaaccgactaaccccgggccataggtaaccgccaccgccgttaggtcttgataactaactccggcttgctccagggcctccttggtacacttggtaatctgttcaatgtggtggcggctggccacttctggtaccaccccaccaaagcgttggtgactagcaatctgcgtcgccacaatgtttgataacacacggtgaccatcttcgatcaccgccacgctggtttcatcacaactcgattcaaaggccaagatcaggtttcgttttaccatttgctcgctgttcccccatcctcattaacttcgttttcatttcgtaggcgtcaccaccgtcgggcaggtagtaatggtgtttttgctgacacacctcaaagcccaggcgacggtacaagtgttgggcgcctcgattttcaatccgcacttctagactcatcgacgtcatcttgtgagccacggccacggccatcatcgccttcattaaataggtccccattccccgtccccggtaagctggggaaacggcaatgttggtgatgtgaccattccgttggtgaaagtgcagtgacaaccccaccaaggccacgatcaccttacccgtagtttccaccaccacgtaaaggcggtcgggccgtttaatatcgcccacgaaggccgctgcgttccacggggcttccccgtagatgacccgttcaatttcgaccaaggtgggggcgtcttcgaccgttgcttggcgcagaatgtacgggtcccccgcaatcatcacccgccgtgtcgcaaagcagagcgagggattacccccttccctagtcatcagccggtgcaataggtcgttaaacttcatgaacgtactcctgggccgtttgaccgggatgttgcttttgccactgggcctcggcttcggtgagtcgtaggtagtctggcaccagggcatccggatcggcgaccggggtggccgttcttcccagcagggccaggtggtacgttgacggcagggttaaatcggcaggcgctaaagttacgttagtgggcaacttggccagctcgtcggccagtttcggtgtgctttgcccaattaacaaaacgccctgtggctgttgggtcaccctaaccattaagtcgctaaaggcgcagtgctgatcttccatcaccgccactaactttcccgcttggtactggtacccaccggcaaagacgttgccacgccgggcgtcgaaaaaggggacgatcaagcgcttgtcatcgggaagaacgttggtcgccaagaccttcaggcttgattcagccaccaagtcaatccccagcgtcgtggccaaaaccttggccgtcgtggtggcaatccggatcccggtgtacgaacccggaccgtttgccaccaccacccggttcaaatccgctggtgtccagcccaaatcatccattaaccgttcaatggtcggcaaaacgtaaacgctgtggttgcggaccatgttcagggtcgtttgggccatgaggcggtcgtcttccaccagggcaatactcatcgggtaattcgaggtgtcaatcgccaaaattttcaattccatcgatcccttctacttttttctaacatacccacgatactcgccccaccagcaattgtccatcctattcgccttagttttgggcgtgtaaaaaggtgcttaaccggcgtaacccttcctttaaaaccggttggggagcgcagtagcctaaacgaacgtggtggggcgtttcgaaagcctccccgggaaccaacaagacgcccgtttgttccagtaaccgggtacaaaaactaaccgtgtcttcttcaattaacaggcggggaaaggaggttgagaccccggccggggccactagggaaaccagcggctccttggccagccagtcttgatacagggcccagttttgttccaccaacgcccggttgcgcgccaaaacctggtgacggtggtttaagacgtaggtggctaacaggtcgttgaccaccccaccacaaatcatggtgtagtcccggacgcttcgcaaacggtcggccacttcccggttcgtcaccgtccagccaatccgcagtcccggtaccgagtaggtctttgacagggaatcggtcgcaatcccccgttcgtagaggtcgacgatcgaacaagccgtcccgtttttcattagtgggtggtaaacctcgtcaaccaaaacgtaagcccctacttcacgggcaatctcagctacccgacttaacgtctccctgtctagtaccgtaccagtggggttattagcgttatttaagcaaatgagcttggttttttcggtgaccaagttagctaactcagccaaccgcggctgccacccttcctcttcgcgtaggcgccagtaatcaaccgtcgctcctagcgagcgtggaatgtcaaataactgttggtaagaagggtactccgcaatcacttgatctccgggctcaaccagtgcgtagaggacggctaggttagcaccagtggccccgttagtttgcagaacctggtcggggtcgacgtgctcgtacagttgcgctaccgcctctttaaaggctggcgaaccttcaatcaaaccgtaattaagcttagcgtcaaagagtaatttgtctagggtattgggatcatcgtccaactcccgtaggtccgccatcgataaggaggcaattgtgctttgtgaaatatcgtagcgggcctttttttcccatttatttaaccaagcttcgacgccaaacggtgctaattcaaccatctgtcccaccctttctattaaaaccattttcatttaatcttagcgcgccttcaccgggtttaacaaggggcgcccggattaaatttagtgcttgcattttaccaccccctggcttagaatgatgaaaattaaatgataagttgctgagaacagatgagtaactagttggcccccacccagagatgtgggggagctgagaaccacggggtggctaactagtgaagatggtctgggagcaagttcgaccagtgaattcattaactggtggcggttgggcccgttatcaccccgggtatctccgtttggacgtacctcgtgagggttttgccgtgagggagaaccgaattagggtggtaacacgcttttaagataacttgaatgcgtccctagagaagacaatggtcttttctagggacgttttttagttcccacaccattgttcagatagaaaggatgtttaattatgaccacaactttaaccgcgccctttaaaaatgacatcgtcggctcctttttgcgtccccaaaagctcaaggaagcccgggagcaattcaagcagggcgaactggatcaagccggtttaaccgccgtggaagacgcctgtatcaccgatttaattgaaaaggaaaaggcggtcggcctgcacgccgtgaccgatggtgaatttcggcggagctggtggcacctggacttcttgtgggggctgaccggggttggtcactacaactaccaccaaagctaccggtttaagggtgccaaaacccgtaccgacaacgccgaactggtcggcaaggtggcctacaaccctgaccaccccttcttcaagcacttccaatttaccaaccagcaggccggcccggacgtcttagctaagcaaacgatcccgtcaccaacgatgctcttccgggataaccgttccgaccactggccggacttttacgaccgctaccaagactacttaactgacctggcaacggcctatcgacaaacgatccaccgcttttacgaactcggctgccgttacctgcaaattgacgacaccacctgggcctttttaatcagtaagctcaacgaaactaaggaccaacctggagaacaccaaaagtacgtccaactgtgccaagacgccgtcaccgtaattaacggagccttaaaagacaagccggccgacctaacaattaccacccacatttgccggggaaacttcaaatcgaccttcctcttttccggtggttacgaaccggtcgctgaatacctgggccaactcaattacgacggttactttttggaatacgacagcgaagaacgcgacggtaactttgccccgctcaagaagatcctcaatcagcgcgaccaggtcaccatcgtcttggggctaatcacctctaaggacggtcaactagaagaccccgaccaagtcatcgcccggatccacgaagccgctaaagaagtgccactagctaacctagccttaagtccccagtgcgggtttgcctccacggaagaaggcaatatcttaaccgaagagcaacaatgggccaagcttaagctcattaaggagattgcggacgcggtttggggctaacgcgtgtcaccccctgaacacaaaagccacctgctacctaatcggtaacgggtggcttttatgttttctaaacgctacatcgctaacgtggttaacaaccgcagacctagcgcctaagtacggccgagcaagttgtttgccacctcttttctacccaacggcaatcgttccgttaaagatcaggaagatggcaattaaactaaaggctaagactacaaccatcgttcccttttcgcccccgctcatcgtccggttattttcacgtaccccttggtagtagatgataaagcccggaataaagctaatcgaaaccaggagcacttgttgccaaccggccaagaacatgcaggcaatttggaagagaaccaacaagagtccaatcgtccactgtccccactcttggtgttcttgactgtacttcatttggtacagccccacaaaaaggtaggagaagaggatggcggcggaggccagtgagtaagcaaagttgtaggcttgttcagtgaagagtaaggagaacaggaagatcgtttgcaaaaccccggtgatcatcagcgaggccgttggggccttcttagcgttgagtttaccccacacctttggcattgccttgtcttcggcaactagcatcgtcgtttcggctggcagcatcgtccaggaaagccaggaaataattaccgaaacaattaagccgacgttgataatcgtggccccccaggaaccaacgatcaacttcaagtcgttccccagggctggttgactagcggcggccagttgggcccgggtcagggtcccgtaaggaataatcgaaatcatcacgtaaatgatcaacaagaggacgaacccgatgatcgtcgcctgttgggcttgggtccggtccttggcccggtgacccatgacggaggccccttcaaccccaatgaagacccagatcagtgtcagcagggtccccttcatctgggtgtataccgagcccgtttccgtccccttggaaaggttgttagcgacgtggccccagaagtcggtcgtaaacataccggccttaaagaagataatcgaaataatgatgaataataccagtggaatgatcttaaagaaggtcccaatcgtgttaataaaggtcgccgtttccaccccgctgttaacgaggagggtcaaaacccaacagaagataatagccacgatgatcgacgttaggttctgcccgttgctaaagaccgggaaaaaggtccccaaggcactcatcagcatggtggcaaaggcaatgttacccaaccaagctgacaaccagtaggcccaaccggaaataaattcccccatcggcccaaagccggcgccggcatatgagaagatacccgcttccaggtccggccgtttttccgataggttgttaagcgcaaaaacgagcatcaaaaagccaaaaccgacgaagagccatgctagtagagcgggcccaggtgccgccgcggcggccaccgcattggtgatcccaaagatccccgtcccgatacaggaactgacgatcagggcaatcagaccaatgcgcccaattccgtttttgttttccatcttgattttcctccttttttcctcaacccgcaaaaaaggtgcaagtgagcccgtggtattgaactgaccactactcacctccaccttctttggttcaatgcgttactaattttcgttatcttagaggtcctcacgtacgattgggcaagacatgcaccgtgggccaccccgaccccgggatagttcactggagcgaacctcgtgaactaagatcccgtgttctttaagcagggcgtttgaaacgtagttacggttgtaagttaccacttcacccggtgcaatcgctaacgtgttggagccgtcgttccattgttcccgtggggccacgattgggtcaccattcccggttggaatcaggtcaatttccggcttgtttaaggcctgcttgaggaccgccttaatgtcagtatggtgctcgatggtaatttcaccatccttgcccgggtgcaagacccagttgtcaacctcacccttgtcatctaggatcgccgggtgaacggtaaactgatcgtggttgatcatcgtgaagaccgtgtccaagtgcatcatagcgtggttatgtgggatcgaaatggcaatcacggtgtcgtagttagaatccttaaagaggtttctagcgatgtcttcgatggcgtccgccgtcgtccgttgggaaaccccaattgctaagacgtggtcggacaagacgagctcgtcgcccccttcgatgtgggattcgtggttccggtcgcgccatacctcaacttgccccgcaaaccgtgggtggtggttgatgatgtattccgtgatcagggattcacgttgacgggccgggaaagtcatcttgttaatggagatcccgtcaccaatggaggcctgcggatcccgcgtgaagtaagcgtttggcattgggtccattaagaacggccagtccgtattttcggaaacggattgcagatccggttgggcgatgtcaatgtcagtcccccgcaccccttcgatgatcttgtcaaccatttcctgcggggtcatttggtagaggtagtcatataaggcgtcgtgggtggtacccgcaacgtaaccagactcggcgatcatccggtttaaaaattcctttctgacgtcgtcacttgccaatgcttcagcggctaacttttcaaagtacagcacttcaatcccctggtcccgtaaggtttgggcaaaaaagtcgtgttcttcttgggcaattggtaagtacggaatgtcatcaaagaggaggcgctccatgtagtcgggcgtaatgttttcaatttcacgtcccggccggtgaagcatcaccgtcttgagctttccaatttcggaggtcacatgaattggacttgtcattgtttctcgcactccttatctagtcttcgtttccagcttcttttattaagcgggtggtgattaaccgtgaatcaccgttcctaacttgccttctagggcctggtctaagccggcgagtgaggtgatgatcgccttgcgttctgggtggcccttcacaaaggacaggcaagcttggatctttggtagcattgaaccagccgggaattgaccggcatcgatcagttcctgggcctgtgcttgacttaattcggtcagcttctgttcgtccggctggttgtagttgatgtaaacgtagtcaaccgccgttaaaatgatcagctggtcggcgtcaacgttatccgccaagagggcactagagcggtccttatcgatgacggccggcactccggttagggcgccgccttcttcgaccaccggcaccccgccaccaccagcggcaatgaccaaggtcccgttttcaattaaggtttcaatgctgtttaactccacgatccgctttggtagcggggatggcactacctgacggtaaccacgaccagcgtcttcgacaaaggtgtagcccttctcttgttcgatctgggcggcttgttccttggtgtagaagtcaccgactggcttagttgggttttcaaaggccgggtcactagggtccactaccacttgggtaaccgtcgtcacaacgtctttttccattccccgctggtggagttcattttgcaaactttgttgcaggtgataaccaatgtagccctggctcatcgccccacactctgggaacggaaacgccgcggtcttcccgttttgagcggcaaaatccatcccgaggttaatttgaccaacttgcggcccgttcccgtggctgatcaccacctggttaccggcttggatcagtccaattaacgaggaagcggtatttttaactaacttcagttgttcttcgggggatttacccaaggcattcccccctaaagcaacgacgacttttgccatgccagttcctcctctttagtcccctaaggttgctaccattacggccttgatcgtgtgcatccggttttcggcttcacggaagaccaccgattgttcactttcaaagacttcgtcggtaacttccatttccgtcaggccaaacttttcagcgatttccttgccgacttccgtttccgtgttgtggaaggcaggtaagcagtgttcgaagatcgccttcgggttttcggttgcttccatgacttccttggtaacttggtacggcttaagcagttcaatccgctttgcccacatgtcgtcggattcacccatggaaacccatacgtcggcgtagattacgtccatgcccttaaccccggccttaacgtcgttagttacgacaatcttagccccggtcttagcggcgatttcgttagcctttgccaaggtttcggcttctggttcaagttcctttggcgtgaccacgtggtattccatccccattacggccgcccctaacatcagggcgttggaaacattgtcgcggccgtcaccaacaaaggcaaacttgatttgttggtatggcttcttcagtacttcgtgagcggtcaagaagtcagccaagacttgagtggggtggtcttcgtcagttaacccgttccaaaccggtaccccggagtattcggccaaaatttcaacgttacgttgggagaaaccacggtattcgatcccgtcgaacatccccccgagtacccgtgcggtgtccttaacggattccttgtggccgatgtgggaaccagatgggccgaggtaggtaacgtgcgccccttgatccttagcccccacttcaaaggagcaacgggtccgcgtggagctcttttcaaagattaaagcgatgttcttaccctttaagtgttgttgttccgtcccggcgtacttagccttcttcaaatcctcagcgaggtcgagcatgtattccatttcacgagtgttaaagtcagccaaagttaagaaactgcggttacgtaagttaaaagccattttcgggccctcctttaatctatcagtgttctctttacaatttttagtatagcaagagctttcaaggaccatcgcaaagcgcccggaatcatcaccaaatccgaacgattttctttttccacctctgtggttgtgaatggaaactcaagtttttgtatattggatgtttatattcaacggacgggcgttttttacccacttcctattcccttttggtgagcaaaaaaacaacttaatcgggtttcaaaaaacttcacactacttcagcttgattcaaaaatggtccaacgagcggcgccccctaacttccccctagtttagttgtcatcaccttaatcacgccattaaatcaattaatttagtacaatctattgctaaaagtcataaaaagtactatttattaaatagtaaccgcttttattctaacgttaaaaagggggagcaccccttcaatcaccttcaatcaccttcaaccaccgtgcgaaaggagctaacccgtgaacttctaccttcttcaagacgaccaggccactagtgcccttctccgtgacctaattgaaaacgacttcgacaacaccctggtcggcttaaccgccgatcccaaccgggcctacgaagaactcctccaactacgggtcgacatcatgatcctcccctaccaacctcacggaatggacggggttgagctaatctaccgcctccaacaagtcaacaaccaaccccacttcatcatggtggggccaccgatccccaccgccaaggaggccgcctaccgggctggctgtgacttttacctttctcaccctctcaaccacaccgaagcgcgccacatcattcgccaggtcgccacccacgtccgcttactcaaccgggtcaaccggatttacgaaatttcctcctcttcaatcgccccgtataaccgaccccaagctgcccaacgccgccaaatggatcacgtggacaccgtcctgcgcttcttagggattgcctccgagacggggagtgaggatatccgtaagatcatccgggtgatgatcgatcaaaaggccagcttttcttccattgatttccagcgcgacttccacgctgatgaccacgaaaaaaagatcgcctaccaacgaatccggcgggccctgcgggtggggatcaccaacctggccaccatgtgcatcgactacccggaaaatgatatcctactcgagtacgccaacaacctctttgagtaccaaaatatccacgtggagatccagcgcctccaccaccaagacgtccggcggggccaggtgtcaatccaacgcttcttcgacggtttgctccaagaatccgcccgcgaccaggaagttgactaagcgtaggaggaaagtgggaaataaccttcgatgcaggtcgtatgtaagatcggacgaacggtttggtgcggcacgcaccgttcttcggcctgcttagaaactaggcctgcggctttttcccacgttttccgttgaacattcgaatatacggcaagaggcaaggagaaaacacggttttctccttgcctctttggtttcaggactgcagtggtccctttatttagttacgatcgttgtagccttgggggtggctttcgtgccacttccaagcggtggcaatgatgtcgtgaacgtcatcgtacttgggcttccaacctaagacgttgcgggccttgtcagaggcggccactaacgaatccggatctcccgggcggcgtggggccatcttagccgggattggtttgccagtgacttcccgggccgcttctagcatttgcttgttggaaaagccggtcgaagaaccgaggttaaaggcgttggattcattcccggcaaagaggtacttaagtgctaggaggtgggcgtcagccagatccattacgtgaacgtagtcacggacgttggtaccatccggggtgttgtaatcatcaccaaagatggacagttcagcgcgcttgccctgggcgacttgcatgatgataggaaccaggtgggtttctgggccgtggtcttcaccaatcgaaccatccggcgctgccccggccacgttgaagtaacgcagggcgacaaacttaaccccgtaagccgaatcggcccaggccatcatgtgttccatcattagcttggacagaccgtatgggttgatcggcttttgcggatcggtttccttaatcggcatgtgttccggcaccccgtaagtggccgccgttgaggagaagacaatgtatttaaccttaaagtcgcgcattgcctcgagcagggtgatcatgccccccgtattgttatcaaagtacttgaggggttcactcattgattccggcacgatggagaaggcggcaaagtggaccaccgccttgatgtcttcgttaatgaaaatttggtctaaaaaggcccggtcgcgaatgtcaccaatgtagaacttggcccgcgggtccacagccttgcggtgaccggttgagaggttatcggcaaccacaacctcctccccgtttgcgagtaagtcctttaccatgtgggaaccaatgtatcccgccccaccagcgactaagattgccatgctgttaccatcctttcgatttttactaaaacttttactacaactagattgtaccacactcgtcgataaaaagcgctttcaatctttaattaagcccggtcggtacgaaagcccccaaacttttggtcaatgtattcaaacaagagcccctcccgtagcccgttgctagaaaacatcacttgcttcatatttaactggcgtaagagggccatgatcggcaacagccccccgataatcacgtcggcccgggccgtcgataccccccgtaccttgccccgctgctcccggtccatccgcagcaggtcgtccatcatttcgtaggcgtcaaccgtctgcatggttaacccgtggaccggcaagggaacgtcctccccgtccgataggcgccaccggtacatcttagctaaggcccggttagagcccccaagggccaccacccgggtgtggcgggcccgactcaaccagcgttgactagagagaacctcatcgactttgattacggcgtcgtacaggttggcggcgcttacttggtcgccaaggtggtaacgttgggacaacaggaccgaaccgatcggcaaggaaaccgtctcctcggcctggccctggtcaactaagattagttccattgaggccccaccggtatcaatgatgatcccgttttccagtggtagggtccgggaaacccctaggtaatcaaggtaggcctcccgtttgccggagatcacttggatcgtcaggcccacctcttgttcaacgcgctccagaaagtcccgttggttggtagcttggcgaacggcggcggtggccacggcgatgatctcaccgtcaaactggtcgtaaatctccttaaagtcctttaacgccttcagggtcctggccataggctcctcttttagcgtccgctccggacccatgttttctgacaggcgcacgtactctttttcgtagcgcagtagttccgtttggccatcatctaaaattttggtgatccgcagacgcaccgagttagatcccaaatcaatcacctttaagttggttgacattttcctcccccttttacttcttgaggcgtaggttattgacgtgacgactaagggtttcaaagacgttgtttaagtggcgccggttcttttgttcttggcgctgccctcgttcttgttgtttaacctgatcaacgaagatctcttggcaatcgacctgaccgctgaacggcagcggggtgtaccggtcgccctttagaacccgggtcttgacgtcgtcttgccacattgtatcaaaaatttcgatcgcccgtgccttggtatcttcttgggtgaccgggaagagctcttcaacccgccggttaaggtttctggtcatcatgtcggccgaggctaagtagatctccgagtgcccgttggcctcaaagtagtaaatccgcgagtgttccaaaaagcgcccgacaattgagtggaccgtgatgttaccgtgtaagaacggtaaatcgtttctcaggcacgtaatcccccggatcaatagctccaccttcaccccggccgcagcagcagcgtataggtgggcgataatttgtttatccgacagggaattcattttcatccggatcttggccggcagtcccttgttggccacctcaatttgttcatcaatcttttcgttaatgaagttgcgaatcccacccggtgaaacccgcaacttgtggaagtaccgtggccgggcgaaaccggacagcatgttaaagaggttggttaagtcgaccccgagttcgtaatcacaggtaaacaaccccatatcggtgtagaagttggcggtcacgtcattgtaattcccggttcccaggtgcatgtagcggcgaattccgtcttcatcgcggcgaatgaccaaggcgagcttacagtgggtcttgagccccactaacccgtaaattacgtggcaacccatccgctctagccgacgagcccagtgaacgttgttttgttcatcgaaccgggccttaacttccaccagcaccgttacctgtttgccctgctgggctgccatccccaagtacttgatgattggagaatttccggatacccggtagagggtcatcttgatcgctagggtcttggggtcggtggccgcctggtgaataaagttaacgacggcttggaaatcatcgtaggggtgttgcatcaggtggtccttttcccgaatggcgtcaaataagttgtgttccatatccaattccggggctaggtacggggtaaacttgctgtagcggtcttcttcgtggtcggaaaccatgccggagagcttctttaaaaaggttaagtcaatcgggcccgcaatgcggtaaaccccttcttcgccgaccttaaggttatcaatcaggtgggccgccagccaatcgtccatcccctgctccacttctaggcgaataacgtgaccgtgctcgcgttcccgcaactggtgctgaaccgcccgcaacaagtcggaggtgtcttcttcggccacgtccaggtccatgtcccgcacgacccggtaagtaccagttgcttgcacggcgtagcccgggaagaggacgctgataaaggtcttgatcacgtcgtctaagaggacaaagatgttggatgacggcatcttaaccaaccgcttatagacctcgggaacccggacggtggcgaattcctcttcgtacttaccgtcttgttcctttttttcgtggggctgggaaatggtggtcaccacttcctgatcgccctcgagcacttccttagcggtcgttgccggagccgtacgaatcagcttaacggccacgtttaaggagttattagagataaaggggaagggccgcgatgagtcgtcggccatcggggttaggaccggtaataattcatcgttaaagtaacgctgcaagtagtcgtgttggtgttgatccaagtccttaacggctaccaggtggatgtctttagcttccaaggccggaagtaagacgtccttatacacctggtagcgccgggccaccatctggtgctccttttcgttgaccgccgtcagttgtgctgccggggtcatcccggaggcgtccgttgtcgttaccccagcggcggctaacttactcaaagaagccacccgcaccatgaagaattcatcgacgttactttgggtaatccccaaaaaattggcccgttccaacagggggttggttgggctggcggcttcttctaacacccgcccattaaagtcaatccaggatagttcccggttcacgtaattttctggttggtaaaaatccctgtagtccatttagttgtccccctttgcaattaactccggttgcaaaccataaacgtcggtgaataacttatttttacgttggaaggcccacttttctagcaccaagtcatcgctagcgtgggcataaatcaagaggcggttgccttccaaagcgagttctaacttactaatcttttgctggcgggagtcgtctagcgaatcggccacccgtaaaatagccgccaacttggccaccggtagctgaatttcgtcatccatgttccggtagtggtgttcatcaacgtccgggctttccgacgagtggtagcgagaaacctccgcaatcacccggttatcttgatccgaaaggccgatcagggggttggcctctaaaatgtaagcggagtgccggtagtgcccctgggggctgatgaagttaccgatgtcatcaaccttgctggcgatctcaactaacaagcggtagtgctcgtccaagcggtggatcggggcgagagcgtcaaacagttccaaggtcaccttggttacaaaagcgcggtgggccaatttgaccccgtagcgacgggcaatgttgtccgccgacgtccgaatcatctggctaatttgggattcctgcccttcacggacggcgattaagccttcaaagggggtcaccccagttacgtaaagctgcttagcgtgtaggagccgcaacgtttgggagataattaaaaagcttggtaacacccaacccacgctttgttcatccacttggtagtggttgataacgtactggtcggtcgagtcggtaatccgtcggtagctggtgtcaaagtcatccaaggccacttcccctaggaattgcccacgctccaagtaggcgtccgctaacaccgagaccccctggacgatcagcgtggcgttttcaacgtcgcccagttcccccactaggtattcgaccttgctactaatgtagtcgaatatgatgtcactcggcgtggccgtggtctgccgtaggttctcggcgagttgactgattttggccttccctaagtcgatgttccaagaggtctcaaagacgccctttttaaagtaagcgagggtactagtcgatagtcccactaacagaacaaaggtatccgccccttctttgatcccttggcgtttgtgctgatgcttaattgcaactaaggtccgagcgataagctggttgtcactaagccagttaacttccagcccgcagcggacgcttaattgatcggccacgtaacgggccgttacctcatctaggtcctctagggccccgtaaaattccacctcgtctacttggtactccttgaggacccgttgaaacccaatcaggttgtcgacaatcgcatccatattttcggcatagttggccaccatgctagtccccacgtttaggttccccgattcgacggttgtcaccggtcgtttctcctggcgatcaatgatccggagtcccacttgatcgggctccaaaaacatgatcccaccgtaccgttgctttgccacgttcaccactccccatcataattaagttcttcctttaggatagcacgattattacttttctgttgatcaaaaacgggatcagcccccaaagtcgtttccgactcccgtaaggtctgatcccgtttcatttaattccgtggttgccagtaaaaggtcgcccgggcgctctcttgtccttggcaggtgatttggtgatgggtcaccattagcccctctttttcaaccggggtcgacccggtgctcgtaaccgtttgcccgtagcgaacttcgtgggcaaactcggtctgcatcttaactacctggtgggtgcgcaaaaagtcgccgtccaagacgtccatcatccactcaaagtagtgggcgttattgacgtgttggttaccatcgatgtcaaagtaacgaacacggtagtcccgtttcgcccagccggcttggtcttctggcaggctgggtttttccaggcgtggtaagcgcttggtttcgtccatctggaaggtatcaatcatctcctggggaatcgtcataatcttacgcttggccaggttcatgaagacaaaggtcccactcaccttagcgtagtagttgcccgctaaatccttgacccaaaagtcacgaatcacaaagaagcggttgtacgcccggacccgagtccctaagattacctcttcacccttcaccggttgcttttcagctagggttccttcgtagttgatgatcacccagccaccaccgtactggcccgcccgctttaggccgaccccgttttccttgttatcggcttcggaagcgaggatcagcattgcgacgatcatggccagggtggggtgaccactggtgtcacattcgtagtacttaacgtggtggtgcatttcaaattccgttgccatcctgctcgttcgatccttcctataattggtggtactgcttatacaagtcctgacggttcaagccgagccgtttggcgacctgcttaatcgcggcgttaggactttgaccgccatccacggcggattgaatttgttctaagggcgttcccgaggggcgttgttcatcttcttgggggtggtcattgccggccaccatcaccacaaactcgccccggaccccttcttttgcccacgccacgagttccgctaggctgccccgctcaaactcttcgtagcgcttggtcaattcccgggccaaaacggcttggcgctcctctccaaaaacctcagccatcgtggttaaggttttagccaaccggtggggcgcctcgtaaaaaatcatcgtttcgccccggttccttaaggccgttaattctgtcacctgttgctggtgcttgcgctccaagaaaccgtaaaagtagaagggctggggggaaagtcctgaagcaatcaaagcggtgagcgcggcgttggccccggggagggggaccaccggaatcccttctttaacgcaggccgccactagctccttgccggggtctgaaatcgatggcatcccagcgtcactgcactgggccaagttttccccttgctttaagcgggccaccagctctggcagccgctgttcagtgttgtgttcgtgaaagctaatcgccttggtggtaatctcaaagtggtttagtagctgccgggtgtggcgggtatcctcggcacaaatcaggtcaacctcttttagcaccttaatcgcccggaaggtcatgtcgtctaagttaccaatgggagtgggtactaagtacagccgccccgtttcggttgcttgaaaacttgcctgtctttgcatccctattttcctttcttacgcgggtttaacgccgattgacaaaagaggcactcatcatcgcgacgctttccgtagtattcgtgacagatgtgaaagccctcctcgtagatcttttggagcttcttttgtgaagccgtcagcccaccggcatccttttggctctgtgattccaataggcgccttaggtggtcattttcaattgacaaggcggcgttttcttctaatacctgcgtcatcatcttttgcaacccctccatgctgaccactagttccctgatctgctgaatggcctggttcaagcgatcatacaggttgcccttatcaaggtgttcactcacggttgctgcccctttcctcactaaagtcacccttcatcaccaagaggaggcggagcgttaattgctccaccacattttgaaagcttatgttttgatcaagcaagtggcgcccctctaaggttagttcactggccacgagaacttgctgggccgaacttggcatgatcagttgggccacttctgcttgccactgacgaaagtgaagccgctctggttcggtcacccggttctttaacaagagggcgtcgcgccaaaccatcgtcactaggtccaacaagactagttgctttgcccggtcgctaccctgctttaaaaaaccagtttggacgtccacaaagctgagcggatcgccactagctacctccttaaaccagtcgaaaactagtttcacgctggtggggagccagtcgtcttccatcaaagaggccccctgcttggcgcttagtcccagccccgcggccagggggcccaggtattctggtacccccgcctcttgcagctgctctttaaccatttcacttggcaaggggcgtaattcgattacttggcaccgggattgaaccgtctgcaaaacggcatttttgttaggagttaacaaaaagatgtagacccccggtccgggttcttcgataaatttcaataaggagttagcagccgagccggttaaggtttcggccccctcgatgatgaacacctttttctccccttcaaccccggttttggaaaattcagcctttagatagcggacctgatcaaccttaatctgacgcccctcgggacgggcaaccaccacgtccgggtggttccccgaaagaacccgctggcactctgggcacgtccgatcgggatgcccctggtcgtcttgatgggggcaaaacaagcgtaatgcgacctccgttgctaacgcgaccgttcccatgttgacgttgcccactaggaggtaggcgtgagccagcgtcccccgctcaattaggctggcaaagcgcgccgtgatttcaggttgtagtgcggtggcggttagctcacgctccatgttctcttccctccgtcctagaagtgtaagaactgctcaaccggtaagacgaagacggtcgcgcccccgacttgcacgttaattggcatggcgcccgccccgttatccatgtgggtaggcggcgtcatgtattgctcccgggactcggcgtttttcttgatgatctctaagacatcgtcaacacgatcgtcggcgaccccaatcaaaaaggtcgtgttcccttcccgcaaaaagcccccggtactcgaaagtttggtggcgccaatcttggcgtcgttaaaggcgtcgcgaaggcggttgctgtcttttggttgcacaatggccataatcatcttcatgacggttcctccttagttggtaaataggtctgcgtaacgtgcgtgaattgcgcttcgtacgtcttcaattacccgcgctaattcctgatcggcgtttaccttcacaattcgttctgggaagcgctcggccagggttaagtaggcctgacggacccgccggtggaagttggtggtttgctcatccaagcggttaattgtctccgcccgtcccttttcaatccgggctaacccggtttccacggggaggtccaaaaaaatggttaggtccggcaagagaccgtcaatggcgtactggtttaactcccagattcggtcgatccctaactcacgtcccccaccctggtaggcaattgaactatccaagtagcggtcgcacaaaattagcttccccgcttcaagtgccggtttaagggtttcaaccacgtgttggcgccgggaagccgcgtataataaggcctccgtccagtcatccatcgccccgttttgcttatctaacaagaccgcccgtacttgttcggcgattgggtttcccccgggttcacgggtatagacaacttgatcacccaactggttaactaggcccgtccggatcgcggttaagacacttgtcttcccggccccgtctggcccctcaaaactaataaatcgtccgctcatctcttggtgcgcccctatcttattgcataattacaccagcgttggtcttaccgtgcaagcctcgcttacgtgcccgttcgtacaagtataagtacttacgctcttgcagcttagttcgctccttgagctcgttattaacatggctttcgtaaacagcttgctccgtttcctttgcgtgatcccagctggccttggtttggtaaatcaagtttaacaagcgttggttaccttcctgttcaacttgatgttgtggtcgtttgaaaaacatcttacatctccgttcgcccttgaaccgcccggaagagggtcacttcatcagtgtaatcaatgtccgcccccgctgataaaccatgggctaagcgggttactttgatcccagctggcttaatcaagtgggccaagtactgggcggtggtttccccgtctaaagaagcgttggtggccacgatcacctcttggatttccttatgcgcttcaaggcgctttaagaggctctccaagttaatgtcttgggggcccgtcccttcgcttggcgatatcgtcccgtgtaagacgtggtaaaggccgtggtattccttcatccgttccatggccataatgtctctggaccgttccaccaccaagacccggctttggtcacgggtcttatccttacaaatgggacacgggtcgtcttcggtaatgttcccgcacacgctgcagtagtgcaagtcgcgcttaacggcccttaacgacttggcaaagttatccacgtccgcatcggacatgcccaaggtgtaaaaggcgagccgggtggcagatttctccccgattcccggcagcttcatgtagctatcgattaaacgggcaatcggttctgggtactgcatttgctcacctaaaccttacattcctaacccgcgggtgtacttacccatcttagcttgggtggcctgttcaaccttgtctaagccatcgttaaccgccgctacgattaagtcgcttaacatatccacgtcatctgggtccaccgcctctgggttaatcttcaaatccttgagcttcttgtccccggttaaagtcgccgttaccatttcgtccggcgcttggccaacaaattccatggccgctaattcttcttgttcggccatcatttgcttttgcattttttgggcttgcttcatcatcttttgcatgttcattccgcgcatcataattcattaccatcctttattattaatcgttttttacttcaattgcgtccgggccaaacaacttttcggcctgactgactaccggatcagttgccttgggggcctcctttttagcggttcccttttttaagtaaccattttccactaagaagtcttggcgcatttggggccacttgtccttaggcacgaagaccacttggcgttcgctaccggtcaactgttgtagggccgcccccattgcgttacctaggttgcccccgttggcctgttcaaagaggaagttattatcaaaggataccacgacccccgccggactggcagccaccggctcagaattattgatcaacgagctctgagcgttatctaataaggaaagcatgtctccccacaggccctttaaattctctaactcaggccgggttgcgttggtcaagatcaagttaacctgggctaagttaatccgcaacgcctgtttattgctagtcgaccggctcggccttggcgccggtgttttcacctctgctggtggggtttggcgtagctgattaacctcttgttgtaaggcagctaccgcctggcgaagctgcgtaagttccgcttggtcagcacctggctgggttctttcgtcccctctaatctggcacaaccggacggttaacacttctaggtagacgtccgggtgcgtcgtaaagcgcatctcctgttggatatcgtttagggtatcgatcatttgatacagagccgtcgaacttgcggcgccgctcagttgatcaaaatcttccttacgtaggcccgtcgccggtaggtcaatcaaacttggtgattcctggtacaagaggacgtcgcgaataaaggagatcaggtcctcaatgaaacgctgaccgtccttgcccgccccggtgatcttagtaagggtctctaaggccggggcgctatcacccttggctacttgcaggaaatattcctgcaccagctgcttggtcacactcccggtcaccaataaggcgtcatcaatggtcacctgctcatcgccaaaggacagtgcctggtcgagaatacttaaggcgtcccgcattcccccctcagcggcgttggcaatcacccatagggcgtcctcttggtaggcgacctttttttgatccaggatgtatttcatccgctcaaaggcgtcctttgcgctaattcgtctaaaatcaaagcgctgaacccgggaaatgatcgtcagcgggatcttgtgcggttccgtagtagccaaaataaagatcacgttggctggcggttcctccaaggttttcaagagggcgttgaaggccccggtcgataacatgtggacttcgtcaatgatataaaccttatagtcagcctgggtgggggcgtacttgaccttatctctaatgtcacggatctgctcaaccccgttattggaagcggcgtcgatttcaattacgtcatttagttgccccgccgtgattgcttggcagagttcgcactcgttgcagggttccccatccgtttggtggtggcagtttaccgccttggcaaaaattttcgccgccgatgtcttccccgttccccgtggaccggcaaagaggtaggcgtgactaatttttttggtgatgatggcgttttttaaggtggtcgaaacgatctgctgaccaacgaggtcactaaaccgctggggtcgccaaacccggtagagcgcctgataactcatctctgttcctccctgcttttgaagatatctttatccattatactagcttttaatcatctaccaaaagagatatctcaaaattcaaagaggctgggagaaaacaatgtttctcccagcctcctggttaatttcattcaaacttagggcacaaggaatcgcaaacttagtgctgctcccttccaggcctgacacggttcgtaaggacgcccttgccctaaggcctaacggcaaaaaagattatacactatttttcggtcactgaccagccttttgagccgcattttcttcctggcgccgttttttcttcgccgtcttttgccgcttacggatcgcccgaaagaactccttgagcatttgactggcttcttcttgcattaggccctggtgaacttcaacttggtggttcaagcgggtatcttctaataggtggtaaagggaggataccgcccccgccttttcatccggggtcgcaaaaaagactcgtttaatccgtgaattgatgatcgccccagaacacatgatgcacggttcaagggtgacgtaaagatcacattcttctagtcgccacgaacccaacgcttggcaggcctccatgattgctaatacttcagcgtggtaggtggcatcttggaatttttcccgcatgttgtgtcctcgtccgataattttccccttataaacgacgaccgccccaattggaacttcgcccagcaaggccgcttggttagcctccttgaaggcctccttcatataaccacgctccgttattttttcttccattctttgccccccttttagctagttttttatcgctcttcagtgtacaatatgctcttagttactttcaaatctgtcgatatgactgttcaatcatcggctaaaaatttttcaactttttttgattcggtcctaaccacgtcccatcaaccaccatatcttgtgttatcgttttcgaccagcacgagatatggtggtctttttatgattgatcggctatactagaaaacatcaaatattggtaagggaggaaatgctcatggtaaccgtcttttccaagaataattgcattcaatgcaaaatgaccaagcgtttcttagaggaacacaatgtagcgttcattgaacacaacatcgatgaacaacctgaattcatcgaaaacttaaaggcagaaggctttttggcaacccccgtcgttaaacttcccgacggtaatgccttcaccggttttcgaccggatcgcctttcagccttggcctaagggcgctgcaaaaattttacgggcggcgacacctgttctaggtgcccgccctttttattgttattaactcaggtataaaagaaagtaggaacgtgatcaatggctctttcagaaattgatatgaccaaggtgaagtacttcgacctaaacaacgagatcaacatccccaaggatggtcaaatccagttgaacctcgatcaagaagccctagacgactttattaaggaaaacgtggaaccaaacaccaagaagttctcctccgtaatggaacggctaaactggttaatcgaaaacgactacctcgaagaagactttattcgccaatatacgcccgcctttttagatcgactctaccaatacttaaaggaacaagacttccacttccactcctttatggccgcctacaaattttacgcccaatacgccatgcggaccaacgacaaggaatactacctggaaaactacatcgaccgggtggctatgaacgccttgtacctagccaacggggacgaacaactggccatggacctggctgatgagttaatccaccaacgctaccaaccggccacgccaaccttcttaaacgttggtcgcaagcggcgcggggaattcgtttcctgctttgaaatccaagctaccgatgacatgaacacgatcgggcggacgatcaactccgctttgcaactatccaagatcggtggcggggtcggcatcaacttaaataacctccgcgaagccggcgccccaatcaagaagatcaagggagccgcttccggggttgtcccggtcatgaagctcttagaagacgccttttcatactccaaccaactggggcagcgccaaggagcgggggttgtttacctctccgtcttccaccccgacatcattgactttttgggggccaaaaaggaaaacgccgacgaaaaggttcgcttaaagaccctttccctgggggtaacggtgccggacaagttctaccagttagtggaagaagacgccccaatgtacctcttctccccgtacgacgtggaacgaatctacggtaagcccttctcttacgttgacatcaccaaggaatacgacaacctggtcgctaaccctgaaatcaccaagaagaaggtcaacgcccgtgagttggaagacgaaatctccaagttacaacaagaatctggctacccatacattgttaacgtcgatacggttaacaaggccaacccaattgaaggaacaatcgtaatgtccaacctctgttccgaaattgcccaagttcagattccgtcccgggtcaacgatgaccaaacctacgaaaccctcggcaccgacgtttcttgtaacctcggttccacaaacatcgctaacctgatggaaacaccagacctcggacgctccgttcgggcgatgatgcgtggtctgacccacatttccgatgctgaaagcttaaccgtagtcccatccatcaagcacggcaacgacctttcccactcggttgggttaggagcgatggggctacacggcttcttagctaagcaccacatcatgtacggttctccggttgcccttgagttcaccagcgtttacttcatgcttttaaactactggaccttagtggcttctaacgaaatcgcccaggaaaagggtgaaaaatttgccaacttcgaacggtctgcctacgctgacggttcctactttgacaagtacctgactaaggactgggggccaaagtccgccgccgttaaggaactctttgccggcttctttatcccaaccccagacgactggcaagaactcaagcaacgggttcaagaatccggtctctacaatgcctaccgcctcgccgtggcaccgaacggctcgacctcttacattggggactccacgtctagcctacaccccattatcaaccggatcgaagaacggcaagaaaagatgattggtaaggtctactacccggccccatacctatccaacgacacgatgccgtactaccgctccgcttacgatacggacatgcgtagcgtcattgatacctacgccgccgcccaggaacacgtcgaccagtccctgtcgatgaccctgttcatgcgctcgaccattccagccggcatgtacgaatggaaggacgggcggacggaaaagatgaccacccgcgacctaaacatccttcgtcactacgcccaccaaaagggcattaagtcgatttactacatccggaccttcacggatgataacgaagaagtcggcgccaaccaatgtgaatcttgcgtaatttaagctgatcagtcataattaaatcgttcacattaacaaattaattgatagggagattaatcgaatggcaattaagaattataaagcaatcaattggaaccaagtgtccgatatgattgacaaggcgacctgggagaagttgacggaacaattctggctagacacccggatcccggtttcaaacgacctggatgactggcgcgaattagacgacgaccacaaatggacggttggccacgtcttcggtggcttgaccctgctggataccttgcaatcagaagctgggctgaccgctttgaaacaagacgttaagacccctcacgaaacggcggtcttaaacaacatccaattcatggaatccgttcacgccaagtcttactcaacgattttctccaccttaaacacgccagacgaaatcgatgaaatcttctcatggtccgatagtgaagaatacctgcaaagcaaggccgttaaaattggtaacctctacttggacgcccaagaagacccgctgaagaaaaaggtggctaacgtctttttggaaaccttcttattctactccggcttctacaccccgctgtactacttggggcacaacaagcttaacaacgttgctgaaatcatcaagttgattttgcgggacgaatccgtccacggcacttacattggctacaagttccaagttggcatgaaccaactgaccgaaaagcaacaacaagacatgaagcgttggatgtacgacttcttgtacgaactttacgacaacgaagagaagtacactcacgtcttatacgaccaaatcggctggaccgatgacgtcttggtcttcatccgctacaacgctaacaaggccttaatgaaccttggtcaagacccactcttccctgacacggcttccgatgtcaacccagtggtcatgaacgggatctccacgaccacgtccaaccacgacttcttcagccaagttgggaatggttaccgcctgggggccgttgaagcaatgagcgacagcgactaccacgtggccgacccgaacgccggcaaggacattaacgctaaggactaatttcaagtaaaagcacccgcgtaaaaacacccgccatggtcacgtgttatggaggattagctcagttgggagagcgtctgccttacaagcagagggtcacaggttcgagccctgtatcctccatttgagccgttagctcagttggtagagcatctgacttttaatcagagggtcgacggttcgagcccgtcacggctcattgccacttgtgggttttatacgccgacttagctcagttggcagagcacctgtcttgtaaacagggggtcggaggttcgagccctctagtcggcatcaaacttaatattatgcggaagtagttcagtggtagaacatcaccttgccatggtgggggtcgcgggttcgaatcccgtcttccgctttgccaattctatataatgccggggtggcggaattggcagacgcacaggacttaaaatcctgcggtcagtgatgaccgtaccggttcgatcccggtcctcggcaccatacgcacccatagcgcaattggatagagtgtctgactacgaatcagaaggttgaaggttcgactccttctgggtgcatttaacgggaaatagctcagcttggtagagcacctggtttgggaccagggggtcgcaggttcgaatcctgttttcccgatttacaatttaatagtaattgtagtatctttttcgcggtgtagctcagctggctagagcgtccggttcatacccgggaggtcgagggttcgatcccccccgccgcgatttgggtggttgtattggacctttagctcagttggttagagcaagcggctcataaccgcccggtcgtaggttcgagtcctacaaggtccatcaagcccatcgcttgatggtgctgttgtacactttcagctttatggaggattacccaagtggctgaagggggcggtcttgaaaaccgctaggtcgttagcgcggcgcaagagttcgaatctcttatcctccttatattatcgcggggtagagcagtctggtagctcgtcgggctcataacccggaggtcgttggttcaaatccagcccccgcaatttctttggtccgttggtctagctggttaggacgcatccctgtcacggatgagatcacgagttcgagtctcgtacggaccgttttaatatatactggctcagtagctcagttggtagagcaatggattgaagctccatgtgtcggcggttcgattccgtcctgcgccatgttgcgggtatagtttagtggtaaaaccacagccttccaagctgttgtcgcgagttcgattctcgttacccgcttttagatgggtctatagctcagctggttagagcgcacgcctgataagcgtgaggtcggtggttcgagtccacttagacccatttggagaattactcaagtggctgaagaggcgcccctgctaagggtgtaggtcgggaaaccggcgcgagagttcgaatctctcattctccgtattgacaccatgggtgttgcccgtggtgtttttttacggccacagcttctctttaaaagtggccggtaagttagcaaattagtccttgcaattatgataataacttgctatactatatactgttgtcagttatgatgacccgttggtcaagtggttaagacaccaccctttcacggtggtatcatgggttcgaatcccgtacgggtcacttttattatcgcggggtagagcagtctggtagctcgtcgggctcataacccggaggccgttggttcaaatccagcccccgcaatttctttggtccgttggtctagctggttaggacgcatccctgtcacggatgagatcacgagttcgagtctcgtacggaccgtctatagaagaaaaaggatcggtgtttaaccgatccttttttgtagtttaaaaaacgaaataatcttggtggtagaaggtgttttgcggacccggggcttggaattcctttaggacccttgctggtacactttcagtccaattgctaagggcgccagcattatcccacgtggttaacatcacaatagctcccgttcgatcttgattacgtaacaacattcctccgttaaaaccgggctgatccgtcaggtcaaccagaagttgacgagcatgctttaaaagtactttttcgggatcagcatctaagtgataagattccaggtgaatgaagggaccaaagttggttaggagaccgttttgttgaagggttgtaaaactaatcgggttagagaagatgggcttctcaccggaaagatcaaagagggtgcaccgagtttggtcagcggcgtccatcgtcataacaaggtgacggctggggtacttagctaagaatggttccaacacccctttggaaccagatgtatatgagatttgatttagcatgggaaattctcctttcgaggtctattctactcggttttcttaacatggaacgaagatgagcctattttcttttaccagggttggtagttagtaattgggatgatcggttgataataagcgggtaccatgttctaaaggaaggggttaccagagtgagaaaacggaatggttgacatagcgttatttgactatgaatgggagggcggtaaattacctaattcacttacaaaaaattatgaaaacgtctttcattatttgctagtggaggttataatagttacaaaacgataagagcaggaaagtagaaatgaatggaggcatctcagatggttacactttacacgtctccgagttgcacctcttgccgtaaggcccgggggtggctacgggatcaccagattccctttactgaacggaacatttttgccgatccgttgacaatggctgaaattaaaaatattctccggatgaccgaaaacgggactgaagatatcatttcgaaacggtcaaaggcctaccagagcctcaagatcgacgttgacgacctaccaatgacggaactttacgaattgattcgcaagacccctggtttgttacggcgtccgatcatcattgatgacaagcggcttcaaattgggtataacgaggatgaaattcgtcgtttcctaccacgggaagtccgggcccttgagttagcggaagcgcaacggcgggcagatttggttgaataatgaacggggatggcaattggttggccatcctcttttgttatgggctctccctttacttttcgtcaggatccgttaaaattactaagtaatgaataagcaaaaccaatctgtgaaattgggagtgagggggcgcaaaatgaaagttaaaagaatcaatgattacacgctccaagtgatgctccaaaaggatgagttgaccgagcggggcattggtatgatggatttgatggggaaccaacagcaaatggaagactttttccagaccgtgttagacgaggtagaccctcagcatcaattttcgatggatcaaacggtgctgtttcaggtgatgccaactaacgacggaatccagttaacgattactaagcacaatggcgacgttaccgaccaagacgtccaagaacaagccgctgaaaatatctcccggttcttacaaaatgaactacgggggcacgatttcgataagaatgaccagcgaagccacggggctgatgcgagtgaacaaactcacgatgatgccgatgagattgccgcggccttaaatgaccctgacgttaaaaaatatacccgggtggtgaagtttgattcctttgaagacttcgtcgcccttgccaaggtgattgataccagtaacatggcggcggacttataccaagaagaccaccattacattttggtggtgaccttctttgaaaacggcgaactttcgccggaaagtgtaaaggatcgcttagccgtcatttacgaatacgcttcgccaagtaaattggaagccatggtagttgctgaacacggccaccgggtgatggagcacgccgcctttgaattggcacgccactacttcagttaatttcgtgacaagcaaaaatccctccgtacttactgagtaaggagggatttttatgttagtggctaaaaacgaacggggacaactggtgcgggctagcgatgcccaacggacgcgagggtaccgttgcccagaatgtgacgccccactcgtcttacgacagggcagccgggtgccgcattttgctcaccggcctaaacagggttgtcagttggcaaaaggggagagtgagctgcacttgctagggaaagagaccttgtggtggtgggccaagcaacggggatggaatccccaactagaggttccgtttgaccagatcgagcaacgagcggacgttttagtgaccatccagaatcacccggttgccttggaatttcagtgtagccccctgagcgcacgtcggctagctgaacggacccaaggttatcagcaagtaggagtggcggttcgttggctactgggtccaacttaccaaaagcggctcctccaccgtgaaatccaagcgcgttttacccaactagttaataaccggcccagtttaaccttctgggagccccaccgagcacagttagactacctacagccaatttatcagggccaggttgggaatggtcgttggtgggcgcaggtgggtgttgagacggtcgatctacaccgccacgcctcgctaagggatgggttagttcgtcaagcctaccaagcggggcaccaagtagctgcttgtcccttagttgctcacgggcgtcgagaatggtggcccttaacctttgaacgcccggtacggtggcgcctcatgattttgctggccttagagcagttaccgctaggaaaaagttggcccccactggggtggcaggcttggttagcgacacagacgaagtggttgcccttgccggcccttaccccagtccaacgtcaggcactgcgaatgcaccacctaaacgagttaaccgcggatcttcttcaagcggggatcattaccatccgcggagaagagtaccgttacgttaggctcccccaatggtttgacgactttgatcaaaagctggccttcgttcgccaacaagagggaatctagaaaaaggagtggccaataaactacttagtcatacgacatgtagttagtggccacgtttgctgtctaacattcggatatgaggcaaaacaaaaacgaccttatccaaaaatgaatagggtcgcgatggtggtttgcatgaataaaaccctcaaatatctattaagtcccatactgagtaccattaccggtacgcggactcgaggtcccttatggaggtctaatttcttcactcttttaacataccacgattacccgatctttaaatcgtttttaagtaggacgggttaggttaggcttatttttgacaaatgcctctcgatcgccattaacttaataagttctaaagttagggcgcccctgccgagtgcggcgaaagaagcgttggtgggaatgattgaatttggtgggcgagaccgcctcgaggaaggttgcgtagtcaaaatcgtgaactaaggtgtcgtaatcgggatggttactgtcgtaaatgacggcggtggttgattcggcgacccccagttcattagcaatccgctggtcgtctttaaaggcttgttgactgagttcaccctgtcggtcttccataaacatggctaggtcgagtccgttgtctttagcgatctggtaggcgaggtcagcgctgtagttttgtccctcgtcaattaatgccttttggagccccaataagaattggcgtccccgcttgcgtccctgaaacaaagcggccttatagtcgagggtaacctggtagagggtggcagaaacccgttggcggttggccaaggtgggggcaacgttatatagacgtagggtctgttcgatggtgtgcatattgacgagcggaatgaagttaaaggttaaatcgaggtcgggtagttggtggtcagctcgcaacaggtcttgttcgcagttaaagcaccgggtccctagcgggttgacaaataaagatacttcaagcaccggtaggtacctccaatcattaggtttcggggaaagcccctttaatattgttattttggcaaatttagcaaaacttgtaaagtaatcaggtttggctagcatcatttttgggactaacggagccgttatgatagaatagttgatagctacggaggggatcaaatgattgaagactggcatgcgttcttgttgccctatcaacaagcagttaacgagttaaaggtcaaactacggggaatgcgcaagcaataccaagagagcgcccaacattcacccattgagtttgtcactggacgggtaaaacccgtagatagcattaaagaaaagatggttcgtcgtcacgtttcagaagaccggctagaacaagatatgcaagacattgcgggtttacgtatcatgtgccagttcgttgaagatatttacgcggtggtggacctactgcgtgaacgtggtgatattgcgattttagaggagcgcgattacgtaactaacgttaaaccaagcgggtaccgctcttaccacattgtaattgagtatccggttcagttgatcaccggtgaaaagaagatcttagccgaaattcaggtgcggacgctggcaatgaacttttgggccaccgtggaacactccctgaactataagtaccagggtgactttccgacgaaactggctgatcgcttgcaacgggcggccgcggcggcgtttaaactggaccaagaaatgtctgaaatcagagaagagatccaagaggcgcaaaacctcttttcttacgggaagtcttccggttgggaacgggtcagtggccgtgaccaggaagaacaaaatgataatcaccaagcttaaggggcataaaagagatgaagattgcagtctacacataccgatcaaccgaatcaatgcgggttcgccaagccattttggatggcattcaagggaccccactcgagtatgacgaggatcacccagacatcgtcattaccatcgggggcgatggaacgcttttgtcggcctttcaccattaccaacacctacttgatcaagtacgttttgtggggatccacaccggccacctgggcttttacaccgattggcgcaattatgaggttcaagaactcttaaagagcctgcaaaacgatagcggccagtcggtggcctacccactattagacatggaagcaacgatgagcgatggacgggtcaaacacattgtggccctaaacgagtctactttgcgtaacattgttaaaacaatggtgtgcgacgtttacgttaacgatcagctgtttgagcgtttccggggtgatggactgtgtatctccaccccgaccggttcaacggcctacaacaaatcagcgggcggcgcaatcatggatcccaacatcattggcttccagttagccgaaatggcctccttaaataatcgcgtcttccgaacgttagggtcgccggtcatctttggcaccgatgctaaactgaccttccgcttgcgtgatgattcctcggccgttttaacctgcgaccgagaacagatgatgttagggcaagatgattggcacctccaagaaattacctaccgggtggccaaagaaaaaattcactttgccaagtaccgccacaataacttcttcatgcgggtgaagaattcctttatcggggagacctactaatggaatttaagtggcactacttgggcgagcaaccacgtcggttacggtcggtctttcgctcctttggggtgactaattcgctacttaaggtggccatcttccatggcggtcagatgaggatcaatgatcgggtggcgtgggccattgaccaagttgagcccggcgacgtggtttatttagtggttcctaatgagccggctaatcccaccatcacggtcagtgaccaaacctttgaaatcgcttatgaggatgaagactttttggtgattaataaggaggccggcgtggccaccgttcctgcccatcacgtcgccgtccaagacagcctggtcaaccgggtcaaggggtattaccaacggcaaaattaccccaatcaagtgacccacgtggcaacccgcttggataaggatacgtcggggctagtggtttttccaaagcaccgcttcgcccacgcagtcttagaccgccaactgaaggcccgccaagtcaaaaaagagtacttggcaatggtgcaggggaggttaaccgtaagtcatggttacatcgacgccccgatccgccgggatccggactccttcgtgaaacggttggtggctccggatggcaaggcatcggcaaccgaatactggtgtgaacgggtgacagatacgactagtttggtacgagtccgcttacacacgggccggacccaccagattcgggtccacttttcctttttgggccatcccctattgggagacgatatgtacgggactggctttgggatgccccgtcaagccttgcattgtcaacgggttagtttttactctccctttaagcagaaggtaatttccgtcgccgccccactgcccacggactttcagcgggctgaggatgagtggttaaactaaaagcccccacctagttcgaagggaaccggtgggggtttggcatgtcttaggtggacttatttaacccactgcttaacgcagacgggttctgggcaggcaacatcttgttgaagtaaggttaactgaccggtcgtggtgtcacgagcgtagagggttaagttatcgccattttggttggaggcaaccaggaaggtttcgtcttggctcagttcaaagtcacgtgggaagtcaccagccgtggtgattgattgaatgtgactcagggttaggtcatcattgacggcaaaaacggccagggtgttttctccccggttagaggagtacacgaactttccgtccgaagagatgtgaatggcggcggccccgttgtgggcggtccaatcggccggaatcgtagcaacggtttggacgtgactgaagctgccagtttcagcgtcgtacttaaggacttccagcttggaactcagttcacccaaaacgtaggcaacttgaccgttggggtggaagacgaggtgccgggtcccaaagccagcctctgactggtagcgggatgcttgggtgagcttaccgtcgtcgctaacgtcataaacgaccactaggtccattcccaggtcacagacggccaggcgcttgtcaggcgtcaagtcggcatagtgagcgtggggagcgtcttgttccggcttcggcccacattcgccttggtgagtcacctcatcggtttgggtcagggtgccgtcagaagcaaccttaaagaccgttaccgttcccttgtggtaattggcgctgtatagcaacttccggtcttggtcgtaacccacgtaggccggtggcgcccccgcccccagcttttggtcgattaattcggcttgaccatcctttaattggtaagaggccacgccccccaggtcaccgtcttgcttgatggcgaaaacccggtcgccgacttgttgtaagtaggccggtttttgggaggcagccacgaggcggacattttccagttgctggtggtcgtgattcaaggtgacggcgtacatccccttgctagtcttgctagtgtaagttccaatcaaaaagtcttcgttcacgatagtcactcctttgttagtttcatcactaataatagcagtcaccgcctcaatacgctaggggaaaccagttgccaacctaactagttagtagaaaggatcgatagtaaagtgaaaaaaattgcgcgggccattcagtgggtgcaaaaccacccgggtctctttatctgccccgtttgcggcgatcaggacttacgggtggaagcaagttcgttagtttgcgctgccgggcaccgaaccgattttaacaagcacgggttcttgtactttttgcagggaaagagcaatgatgagtacgaccggtcgatgctgactgagcggcgccggttgctagaggcggggttattcatgccgatggttgaggcggtagctaatcaattgccggtggggtcgcaaaccatcttagacgtgggaactggcgaagggaccccgctcctacagttggcaaagcttcgcaaggaagacgacaccttggtgggctttgatatttccaaggcgggtatccagttggcgacccagctagactttgggggcttcttttgtgtggccgacctgcgtcacctcccgtttaatgcgggggcgtttgacgccgtgattgaattcttttcgccgtctgactatcgggagtttgaccgggtcttagcccctaacgcgaccctaatcaaggtgatccccaactccggctacctggcagagttgcgccacctcttgtacggaaaaacgggtcggcacgccgaatacgataaccaaccggtggtggacctgttcatgcaccactatccgggggctaagcaggtcccggttcgttaccaattcccgttgccaagcgaacttcggtgggcaatggttgaaatgtcaccgctgcattggggaaaggaggtccgtcccattgctgaactggaccttggccaactgactcacgtcacggtggacgtgaccgttttggtcggcgaaaaaagatcgtaatttactagcaatccccaacgagtgtgttaaaataacctttagaaatcatttagtagatgacatcgagcaatcgttggtatttattaaagagcacttcattaaagcagcgtttcgccgtggctacaccgagaccctgctttttttgtattttaaacgctgaaaggattcacgatgacaaatcacattgtattatttgagcccctttttccagctaacaccggtaatattgctagaacctgtgctgggactgataccgtcttacacctcattaagccgctgggcttttcgaccgatgataaacatatgaagcgggccggcctggattactgggacaaggtgaaggtggtttaccacgatgacctagtggcctttttggattcaattgacctagaccacctctacatcgtctctaagtttgccgaacgcgattatagtgaggtggactacaccatcgccggggaccactacttcttgttcggtaaggaaacgaccgggttgccagagggtttcatgcgccgttatcctgaaaaagcaatccgaattcctcaagatgacaacaacatccgggcgctcaacctgtccaataccgcggcaattgtgatttatgaggccctgcgccaacaaggcttcccgaacctcgcccgggtgcacaagtacccatttgataagttaaagtagggggaaattatggcacgcaaagcacggacaacgacccgaccgcgggcaaaggccaagcccaaggtgcaaaaccggttggtcaagagcctgagtgggattttggcgatcctgattttgctagtcggcctctttaaactaggcatcattggtaccctagtgatggggttatttgaactgatcggcggggaaacggccccggaactgatggtggtggccattatttattgcctgggcttgactttatacggacgcttcccccgtgtgaaggtccgctggttaagcggggcggtgctcttttacgccggcctcttattggccctgcacgtggcgatgtttgacagtttaaacgcccatagtcattacttattaaccacttggaatagcctgaatcgagcgattattaatggcgacaccaccgtggcgattggtgggggactattaggggggcttttgtatagcggtaccgtttatttggtggctgatttgggcgcccaagtgttggcctggctgttgatgttggtcggggtcgtcgttttcttcgacctcccgtggcaccgtgtgattgacgggttggcaaccctcgtgagcgccgccattgctaagtaccgggccaagcaaaaggaggcccggcaagcaccaattaagtcccgggttcaacagcgccaccaatcggggctgctagcacgctttaaggaccaccgcccctcgccaaggaccgaggacaaggacctgccggaaccaatcgccgatcaaccaccacaaggcaacgaatcggcagcggccgttgcgccgagcccgagcccggcccctgcgcctaagatcatggtagcggggcaaccgaagcctagcgaaccagcgagcgacgcgggggcggaaccggaattagccggggccaacggtcaagacgatgacgaagactaccaattgccgccaaccacgcttttaaccgaggtggcccctaccgaccaaaccaaggatttggaggcaatcaaggaaaacaccagcaccctgcaagacaccttgcaatcctttggggtcgaggccacggtggaaaatgttagcttaggaccgtccgtgacgaagtacgagcttcgcccagccgtcggggtgaaggtggcgaaaattacccacctggccgatgacttggccttagccctggcggctaaagacatccggatcgaagcgccgatcccgggtaagtcgttggtcggaattgaagtcccgaaccaaaagatcgccacggtgggcttccgctccttagaagaggccacccccaacgatggccgaccgctagcggtgccactcgggcggaccgtttcgggtgacgtaatggtcgccgatctgaccaagatgccccacctcttgatcgccggggcgaccgggagcgggaaatcagtggcgattaacgtcattttaactagtattttatttaaggccaagcctagccaggtgaagatgctcttgattgaccctaagaaggtggaactctctgtctacaatgggatccctcacctgctatcgcccgtagtttccgaccccaaaaaggcggcccgggccctggctaaagtggtggcggaaatggaacgccgctacgagctgtttgccgcctttgggatccgcaacctagctggctataaccaacgggtgactaaggaagaagacgatgaacaccacccgctaccgttgattctcgtcgtcgtggatgaattagccgacctgatgatgacggtttcccatgacgttgaagacgcgatcgtacggattgcccaaatgggtcgggcggccggtatccacatgattatcgccacccaacgcccctccgtggacgtaattaccgggctaatcaaggccaacgtcccgtcccggattgcctttgcggtctcgtccggggtggattcgcggacaatcttagacgctaacggggcggagcgactgttagggcgcggggacatgctcttccagccgatcgacaagaacaagccgattcgggttcagggggcctttatttccgaccaagacgttgaggcggtcgtcaacttcattaaagaggagcgcccagctgaatacgacgaagcgatggtggtgtccgatgccgaaatggaagcggcccaggaagcggaagatacggatccgctgtttgatgaggcgctggactttgttaccgaccagcagcgggcctcgacgtcaatgattcaacgtcggttccggattggctataaccgggcggcccgaatcctagatgaaatggagcagcggggttacgtttcaccagccaacggtgccaaaccccgtgaggtctaccggcaaccagaagaataaaaaacaacctcatcttattggccgcgttttctgtctaacattcgtaaatacaataaggggctaggagaaagtacggtttctcctagccccttattgtattctagtttatttcccacttgcttcgttgactaggcctagagcaagcctaacgaaacgattgccccgaagatcaaagaaccgagcatggcgattaacatcagccaaacggcgaccatggtgatcttttggaagcgggttttcttttttggcattacaagttcactccatcttcattttcttttcgttaagtgtaccgcaacctagtcgttaagatcaaattagagcccattgtgtggtagaattaacgggattgtcagagaggatgcggtgcgcgtgaaaaacattattactgaattggtgatgctagcgggctatggcctggttgaatggttggtcaatcgtttaattcgtcggcaaaagaagccggttcacctgttgtgggtttggacaacattattaataattagttgcctaatcaacctgactttttactggtttgcctatccagtgattatttggatgttgatcggaattggactggtgatccaccagttgtggaccagtcaccagttcttgtaccaacggttttggccgcgcttttggcaactgacggtgtttttttggctcgttgccttcgtgctatcgctgttgggtaaccgactaccagtggtttaagtaggagtggaaaatgacccgggggaccggtggttgttgtccactcctttttcttaaggaattaattattggtacccgtggtgagaagtgggggaatgtggtagactgttggtgtagtttttaatttgggggtaagacgccgtgttcatgggtgaatacacgcatacaatcgacgacaagggccggctgatcatccctgccaagttccgctcccagttgggtgatgatttcattatcacccgggggttggatcattgtttatatggctacccattaatcgagtggcaagctgttcaacaacggctggctagcttaccatcgaccaacgcgaacgcccgtaagttagtgcggtatttttattccgcggcctgcgagtgtcagtttgataaacaagggcgggtcaacttaccggccaacttaatgcaacacgcctacttagagcgggattgtgttgtaattggggtcgcctcccactttgaaatttgggacgccgagcggtgggcaagttaccaggatgctgcagcaagcgattttgaccagttagcagctggttttgatgggcttagcttttagaaaggaggaacgagatggcagaatttaaccacgtaaccgtgctacttcacgaagcggtggcggggcttgccattcagccagcgggtgtctacgttgacgccacgctaggtggtggtggtcacagtggcgagatcttaaaacaactcaccagtggtcacctgtactcctttgaccaggatgaaacggcgatccactataaccaagctaacttaggcccggcgattgaagagggaaaactaaccttaatgcagaccaatttccggaacttaaagcaggccctagctgatcagggagtcacagcaattgacgggatcgtttacgaccttggggtatcatcaccccaattcgatgatgccaagcggggcttttcctatcaacacgatgccccattggatatgcggatgaaccaagaccagcccttatcggcttaccaggtcgttaacgaatggtcataccaagaactagtccggatcctctaccgctacggggaagagaagtttgccaagcaaattgcccgggccattgaacgggcgcgccaaaagcaaccgatccaaacgacgatggagctagccaacatcgttaaggaggcgatccccgccgcggctcgtcgccacggggggcatccggctaagaagagttttcaggcaattcggatcgccgtcaacgacgagctaggggcgctggaggattctttagaacaggccctggcgctcttaaaagttggtggtcggatttccgtgatcaccttccagtccttagaggaccgcttggtgaaaacaatgtttaaagaggcaactagtttaccggacttaccgccgggcctgccggttattccagcggacgcccagcccgactttaaattgatcaacaaaaaaccagtgctcccaaccgaagacgaattgaaggttaaccaccgggcgcacagtgctaaacttcgcgtgattgaaagacttaaataaagataggtagtggaaaacatggcatcgaacgcagcacgacaactaacctccccaaccccgagtaaaattccggccccgcagccgacgcctagcccggccgctaaaccgggacgggtccccttttcaaattttgaaaagttaaccatcgtcctggcggtggcgatggtgatcgggatgacaatcgctttagtcaccaccaagattcaaaccaccagtcggcaacaggttttacagacgatccagcaaaagatcacgacccaaaccagtcaaaacactagtcagcaacaagaaattggggagttaacgagtcagtcgcacctaaagaaaatggcggctaagtacgggttaacggatacgagcgctagtgtaaggaacgttaataagtaatggataagcgccagcaaaagaaacgaacgataaatggggagaacaggcgaaaccgaaagacctttgggatgtggttctttttggtagcggccataattttcattctgtttaccgttcgttttagttatattgccatctttaaggatgttcaaaaccataacttaaaatcgcaggcggccaagctctacactagctcgcaagtgattcaagccaagcgggggacggtctacgatgccgacgggaacccgatcgccacggacactagcaagtacaccgtttatgccatcattgattccagctaccgctcggcaagcggcaaggccctgtacgtcactaacaagaagaagacggctaaagtgttagctaagtacttagacctaagtgaagcccagattctcaagatcctctcgccaagtagtaagggaatctttcaggttcagtttgggacggccggctctaacctgtcagtcgccacgatggaaaagattaaaaaggcaaacctaccagggattaacttcacgcaaatcccggcccgggaatatcccgagggcaactttgctagccagctgctcgggatgaccacgttaaaaaccaacaccaaaaccgggaccacccagttagtgggggacatggggttagaagggtactttaacaaacagctgaccgggacgaatggttaccgaaccgtaaaacaagacgtttatggttaccaactggctgattcgtcaacgaaggggcgtaaggttgaaaacggggataacatcaccacgactttaaacaataaggtccaacaccagatggaaaccttagtgtccaaggtggaaaaggaaacccaagcagaagggattaccgccatcgtgatggaagccaagaccgggaaaatcgtggcggccacccaacggccaaacatgaagtccgaaaccccttcttggaccaacgcattaacgcagcaaacctttgaacctggttcgacgatgaaggtgctagccttagcagccgccattaacagcggaaactttgaccctaacgccacttacacttcaggaacgtggagccttggtggggggaagatcaccgactgggtgaccagtgggtggggaaccatcacctataaagaggggttttaccgctcctctaacgttgggtttgcccacgttgaacaaaacatgggcgccaagacctggatgaaatacatccgccgcttcggcctcctaaagaaggtcaacgtatacggcatggggaacgaaacggcgggttacaccacctttaagggaaagctagaacaggccaacaccgcctatggtcaggggattaccgttaacgtgatggaactgatgcaagcctatactgccattgccaacaacggaaaaatggttaagccctactggatcgaaaaggtgaccgaccccaacaccggtaagacggtgaagaaactgtcaaccaccgtggtggggcacccaatttccgcttcgacggctaaacaggtccgtaagtacatggaaggggtcatttacaacaaggtcggaactgggcagtcctataaggtcagtgggtaccggattgccgggaagaccgggacggcccaaattgccgggacaaacggttacgagaccgggacgaatgattacatctactcttttgccggctttgccccggctaaaaaccccaagtacatcatctacctatcgatgaaaaagccgaagaatttaactaaggcggcggaaacccacctgtcgtcaatttcaacgccgatcatcaagtaccttttggaccaagaaaagctcaagtccgaggggcaacaaggggtagtcaaggttggtaactacgtcggcaagaatgcccaaacggtgcaaacaagcctggcgaaaaagaagttgcaagtcaccgtgattggtggcaataaaaagatcaccgcccagtcgttgacggctggtaaagaggcgatcatcaacagccgtttgatcttaaagaccagcggcgaaatgacgatgccagacgtttctggctggtcacaagcagacgtggcccagttggcacaaatgatggggctaaaactatcattaaccgggagcggctacgcaagtaaccaatcaatcagcgtgggcacccccgttaaggcgggcgacagcttgaaggttgcttatacgggaaagtaagaaagagaagaaaaacgtttaattggaggcaaattaatgagtatcttggtagcgggcttaaccctggtgagtgcatttttgatcacctttttgttaatgccgagtttgatccgctatttccgggcgaaaaaagagggccaacagattcgagaagagggcccaacctggcacgagaaaaaggccggcaccccgacgatggggggcttactcttcatcttgtcagcagcactaacctgcggctgggtgggggcttggcaaggccaactgaatggtgccttaggcgccctgttgttcaccctgatcgcttacggcttaatcgggatgtgggacgactccattaagatctttaaccaccaaaacgaagggtttaagccgtggcaaaagttcttagctcaggtagtgggggcaatggtttttgccgtcatttaccaacacgagggctttcaaatgggctttgggctcaccgactggggctggttttacgccctgtttattatcttttggatggtcgggttctccaacgccgttaacttaacggatggactagacggactggtgaccgggttagcaacgatttcctttgctgcttaccttgtcttagccttagtacaggggcaaactgaagtcgccctcttctgtttggccatgatcgggaccttgttaggtttcttccccttcaaccacaagcccgctaagatttttatgggggatatgggatcactagcgttaggggcaagcctggcggcggtcgccctggttttacaccacgaatggtcgcttctgatcatcgggatcgtgtacgtcttggagaccctgtcggtgattttgcaggtcgcatacttccggcggacgggcaagcggctctttaagatgacgccgattcaccacacctttgaaatgatggggtggagcgaatggaaaattgacagggtcttttggctcgttggtttaattgccggcgcccttacggtggcgacgatcttgtttttaggataatacttggatgagtttgaggtacggattgtgaagcaaattaatgattacaaaggcaaaagggtactggtattagggtttggaattagtggtctgaacgccgcttacctcctccaaaaactgggggcaacggtggtggctaacgatcaacaggttccaaaggacccgcgcgtggtcgccgacttggaaggggcggggattacggccgtgaccggctctaacccgctgagcctggccgaagaaggctttgacctggtggtaaaaaacccggggatcccgtatgatacgccgttagtggcggcctttgttaagaagggaacgcccattatcaccgagctagagttaggttaccaagtctttgcggggcacttgatttcggtgaccggctccaacgggaagacgaccaccacgaccttgattgaacagatggtggccatgggtaacccgcaccgggtggagtacgccggtaacatcggggtgtccttttccaaggtggccgaagagctaggtcctgacgatacgatcgtcaccgaagcctccagtttccaactactgggcgccccaacctaccgcccccacatcgccgtgatcaccaatatcttcgctaaccacttggactaccacaagacgcggcaaaactatattgacgctaagctggggatcacccgcaaccagaccaaagacgattacctggtcatcaactgggataaagaagaatggcaaaagctagctaagcggaccaacgccacggtggtcccgttctcccgtctcgctaagtctcaggagggggcctaccaaaaaggcggcgacctatactggcgacaagaacggatcatggccgctaaagacgtggtcttaattgggccccaaaacgttgaaaacgccctggcagccattgcggcggccaagttatccggggtcgcaaacgaagcgatcgtccgggttttgaccaccttcaccggggttcgccaccgccttcagtacgtgttggactacgaggggcgccgtttttacaatgattccaagtcgaccgacatcgaggcaacagaggtggccttgcaagggttcgagcaaccggtcatcttacttgccggggggcttgaccggggctacaccttcgagcgactggttccttacttcagggagcacgtcaaggccttaattgtcttcggtgagtccaaggataagatgaaggcggctggtgagcaggctggcgtgaagacgattgtcgaaagcacggacgcggtgacggcggtgccagaggcctggcggcttagtgaaccgggcgatgtcatcttgctctccccggctaacgccagctgggaccagttccccaactttgaggtgcgcggggaccggttcattgaggccgttgaacaactgaccggcaaaaaggaggaaaactaatgcgcttaatggtatcggggggcggaaccgggggtcacatttacccggccttagccctaattgagcggttgaagcaggtggaaccagacaccgaggtcctttacgtgggggccaaacggggcctggaaacgaagattgtcccccaggcgggctaccggctggaaaccatggaagttcaggggttccggcggagcctttcgctcgaaaatgttaagactgtctacctctttttaaaggccgttgcccaggctaaaaaactaattaaagactttcgcccagacgtcgttttggggaccgggggctatgtttccggggccgtcttatatgctgcggccaagctgggggtgccaaccgtcatccacgaacaaaactccgtggtgggggtgaccaataagttcttagcgcgttacgtgaatgaagtggcgatcgcctttgaagcggcccggagccagtttgccaagtcgtcagtgacgatgacggggaacccacgggcccaacaggtcgcccagcgcactaattcggcctattcctggaccgaagacgggcttaaagacggggtacccaccatcatgatttttggtggttcccaaggggcgccccgaatcaataaggccgtggttgaggccttaccaagttttaacgagcagccctaccaagtgatcttcgctaccggccggaagcgctacgatgacgttatgggggcgctagcggggcaaccaattggtgataacgttaaggtggtaccatacattgaagacatgccagacaagttgccacacgtcgacgccctggtttcgcgggcgggggccacgacgatcgccgaagtaacggcgctgggaatcccgacgatcctgatcccgtcgccatacgtgacggcaaaccaccaggtgaaaaacgcggaggccctcgtcaaaaagggggcggccctgatgatcttagaggatcaattagacgggcgttccttaattacccaagccaatcacctgatgaatgacgccgccgtccggcaaaagatggcggctaattcaaaggcggttggtcatccagacgctagtgaccaactaatcgccgtcttgaaaaaggcgatcgcagaccaccagaagtagaaaggaggaggggaacatggccaatcaccgtgataaccgggagcaccgccgctacgctgatcgcttggcgacgctagaagctcagagcgtgattgatgggcgtgaccggtttaaaaagcgccaccaggggcttaaaaaggggctccctaagctacgggcctatcaaatcaagagtaacttgggccgggccttgaccgtgttaatccccttcttcatcgttttactggcgatgatctacgtggtttcacccttttctaaggtcaaccaggttaaagtggttggcaatgaggacctgaccgcaaagcaagtggaagccgccagtggtgctaaagctggtgccttcatctggcgcctggtttttgaccaagccgcggtttccaagcaggcgcagcaaaataatttacaggtcaaaagcatccgggtgagcctcgttggcccccggtcggtgaaggtacacgtggttgaaaacccggtgattggaatcgtaacccataacggccaccaagaactcttgctttcgaccggaaagtaccaaaagattagtaacaacctgacgaacttcattacttacgccgggtttgccaagcacgagggaatgctgaccgaaacggccaaacaagttggtcagttgtcggcgacaattcgtcagggaatttcccaagttacttatagcccgacaagtacggatgacgaacggttaaagatttacatgaacgatggtaataccgtgttagccaatgcctcgaccttagcgcagaaaatgaagtactacccgtcgatcgtcaccaatatgaatacggcgggggtgatcgacttacaagtcggtgcctactcgtatgcttatggcgatcaaagtaagtaagtccggaaccggattcatttttgacaatctaggggtttttggacaaggactttctgtggtaaaatttagactaactaaaagtgtaaactaaaggggatttcccttacttttaattaaaatatttttaggaggttccgggagaaatgaacgattcacacatctacgtaggattagatattggaaccacctcgattaaggccctcgtttgcgaggacgttaagggcgaactaagggttgtaggcgttggcacgcaaccggctggtgggcttagtcggggcgtgattgtcgatatcgaaaagacggcccacgccattcaagcggcggttcgtcaggcaaccgagaaatccggcattaagattgataaggtgattgttggtttaccggcgaattacctgcaaatgaccgaggtccacgggatgattacagtggctaaccagggtcaaccacgcgaaatcattaatcaggacgtcattgacgttgcctcggccgcaatgacccaaaacctacccccagagcgggaagtgattgaccttgtcttgcgtgacttcgcggttgatgattttaacaagattgaagacccccggggaatggtggcggtccgcttagagttgcgggccaccatgtactcgggccctaagacgattgtccacaacaccaaaaaggcggtcgccttggcgggcttacagatccaagacttggtggtagccccgattgcaaccggctttgaattattgagtgatggggaacaagacttcgggacggtcttggttgatctcggcggtggtcaaaccacgaccagcatcatccacgaccaccaactcaagtttgcctacgtggacccagaggggggaaacttgattactcacgacatctcaacggtcttaaatacctcccagcgaaacgccgagcaactaaagcgtgatcacggctacgctgattcacgccaggctagcgatgaggtgcaactggcagttgacgtggtcgggaaaaatcagccggtcaattacagcgaaaagtacttagccgaagtgattgaggcccgggtccgccagatctttgaacggtcccaaaagaagcttcagtccattaacgccccgcaactaccagggggcgtggttctcctgggtggggtcgccattttacctggtattaaagaaatcgctagtgagtactacgatggcaacgtcaaggtgtacattcccgaccaaatgggggttcggcacccaagttttgccctggccattgccctgtgcaaatacgaagatgacctgcgtgacgtcgaccaactcctaaaagaaacggtacaccaagagggcaactttgccagtgtggttcaccaggtagtgcaacaagctgcccaaaccagtgcagcaccgcaaccaacccggcgtccggccccgagtcggcctgctccacagccaagtcaaccggaagctcaggcacaagaacaaccggtagacaaccaaccaactaagaagaaaaagaagaatccgttttcgaacttctttaacaacttctttgattaacactgataacgacggaggaaacagtcatggataacgcaaccaacgaattcgatcaattacacccaacccaggcccagattaaggtaatcggggtcggtggtggtggtgggaacgccgtcaaccaaatgattaacgaaaatgttgaaggggttgacttcatcgttgccaacaccgacctgcaggccttagagggttcccacgccaagactaagttacacctggggccgaagctgaccaggggcctgggggccgggtcaaacccagaggttggggccaaggccgctcaagaaagtgaatcagacatcaccaaggccttagaaggggccgacatggtctttgttaccgccggaatgggcgggggtaccgggaccggggccgcaccggtaattgccaagattgccaaggactccggtgccttaaccgtcggggtagtaacgcggccgttctcctttgaagggacgcggcgggccaagttggctgccgaagggttagagaacctggagaaaaacgtcgacaccctgatcgtggtttccaacgaccgcctgttagaaatcatcgacaagaagacgccgatgatggaagcctttaaggaagccgatgacgttctccgccaaggggtggaagggatctctgatttgatcactaaccctggttacattaacttggacttcgctgacattcgtcacacgatgaccaaccaaggggccgctttgatggggattggggccgccggcggtgacgaacgggccaaggaagccaccaagcgggcgatttcttcaccgctgctggaagtttctatcgatggggctgaacacgtgctggttaacgtgacggggggcaaggacttgtccatgaccgaagccgaagacgcctctagcgtaattcgtcaagccgctaacaccaacgtcgacattacctttgggatggccattgacgaaaccttaaacgatgaaatccgcgttacggtaattgcaacggggatcgacaagaccaagcagggcgacgaaaagccagttgaagaagtaagtcagccggccgcacagccggtcagtcaagccccggttcaaccacaggttcaggcacaaccgcgggctagtgccgccccggccccaacgtcggaattcgcaaccaccgatgacccgttccaaaactggaacgaagacctcggcaacgaactagaaggtggcgcccggccgaatagctttaaccacgtcaagaagccaaccttcagcgtccaagatgacaacctgtctaacgttgatgacgggggggaagacctctctaccccggctttctttaagaaccgccgcaagtaacacgaaccgaaaatagaaaatgactggaggaatggcccatggcaagtaaattttttagcaacctttttggggtggtcgacgatgaaccagagacggccgactactacgaagatcagcagccggctcaacaagccccggccccggtgccgactccggccccaacgcgttcaaataaagtcgtttcgatcaataacgcccgggtggctcagcaaccaaattcgtctagcaagattgagctagttgaaccacgggtgtacggggacgggaaggaaatcgtcaaccacctgttaaatggcaacgccgtcattgttaactttgatcagatggacgcaaaggttgccttccggattgtcgagtacatgaagggcgccacctacgccattagcggaaagatcgaacggattgacgcagaaattttcttgtgcaccccccaaaacttcgaaatctcggggaaattagccccgaccctttctagtgatgggttggatgataggagagaccggtattgattattacctttattgtttgggcgcttagccgcctgttgagtttgtatagcctactgattgtgatctggtgcctgttaacctggtttccgggggccatggatagctcactaggccgctttttaagccagctagtggcaccgtacctaaacttttttgaacgagttattcctccactgggcgggatctcctttgccccggtggtggccttgattgtgatttattttgcccagtatggggttcaaatggttgggcaaatcttaatcaacttaatgtagggggagcatgatggagcaggtgaacgtcaagcagcacttccgggcggatgaagccccgtttattgaccaggttaatgattggctgaccacggccggcgaccaataccgtccggtcctgaccgcctttttaaacccccggcaacgttatatcatgcgggtaattgccaatcgtcaagacgaggtcaaggtggcctttaaaggcgcttatccgggcgccgaaatgcagcgcggtttagcttacccagcttattaccagccgacggaagacgatttcgaattacagctgttagaaattaactacccccaaaagttcgcggagcttcatcatcgacaggtaatgggagcggttttgtcaaccggagttgagcggggggcctttggtgacattatcgcaagtgatgagcattggcagattatcgtacaaagacaattaagtgactacctgattgaacaggtaacgtcaatcggtaaagcaaaggtgcgcttagaaaaacgggaattgcaaggggcccgggtaccgcaagaagattggcaagaactcgtcaccacggtcgcttccttacgtttggatgccgtggtggcggccagttttaattattcaagaaaccgggctaagcaactgattgaacgcggtcaggtccgggttaactgggaagaaattgaccgtccggattatgagttagctagccgggacttgatttcggttcggcacggcggccggattaaggtgcaagaggagcttgggcaaaaccgtcacgagcgcactagaattcggttagccgtcatccatgcatagtggacagcgattggaggaactagaatggcattaacagcagaaaacattacaagcaagaaatttgatacgaaaatgcgcggttacaaccaagctgaggtcggggcctttttaaatgaggtagcggcaacggtggcggaactaactagccaaaaccgggaattgcaagaagaagttcgggctaacgaagagaagctcaaatactttgccgacttaaaggactccttgaacaaatccattttggtggctcaagaggcggccgataaggttaaaaacaacgctaaaaaggaagccgagattacggttcgcgaggcccaaaagcaggcgactgacattgtggcggccgctaacgaaaaggctaacttggtgatcgaaagggctgctgcttccacccggaagttgaccacggaaaccaatgacttgaagaagcaaacccggatcttccgtcagcgcctgcaggtaatgttggaatcccaactggaagtcgttaagtcaagcgaatgggacgagctgttggccaacgatgatatttcccaatacgatgaaatcgaaaagattttaggatccaatcttgacaaaaattctgagggcagtgtagaatctactccaatagccgaagaacaaccgagtagtcaagcaccggcaccgtcaaacgcggcggaaccggctgcggctaagacggtcgtcatcttcccggacggggaaagcaagtaggcgaacattaaaacgacgattaaaagcattgatgggaacccgtacgaaacgtcgacgattaagcgagccggtggttggtgcaagaccggtattaagaccttcaagcaaatcatcccagagcgtggtactgaagcgagtaaggaccaccggttcatgaccgttaccaaatgacaaagcaaaaggagcagtccttttgaaatttgggtggtaccacgagtgcgtctcgtccctttgcggacgagacgctttttgtttttaagcgttggattttaaccagagaagggggatttaagatgcgcgttaaagacaccttaaaccttggtaagaccaagttcccaatgcggggacggctcccggaaacggaagcgcagcgagaagcgctgtgggaagaaaacaaggtttatgaacaacgacaaaagttaaacgagggcaagccaagctttgtgcttcacgatggccctccatacgccaacgggccaattcacattggtcatgctatgaacaagatttccaaggacttcatcgttcgctacaagtcgatgaccggctaccgggctccgtacgttcccggttgggacacccacgggttgccgattgaacaccaactgactaaggctggctacgaccgcaagaagatgagcttaactgagttccgggacctgtgtcaaaagtacgccttggagcaagtcgaaattcaaaagaagggctttaagcgcctcggggttgccggggagtgggatcacccatacctgaccctggccaaggaatttgaagcggcccagatcaaggtctttggtgcctttgctaagcggggactcttgtaccaagctaagaagccggtttactggtcttggtcttccgaatccgccctggccgaggccgaagttgaatatcacgatgtcgttgcgaagaccgcctttttcaccgaacaggttcaggatggcaagggactgctcgattccgatacttacctggtgggctggacaacgacgccatggacgatcccggcctctgaagcggttgccgtcagcgctgacttcgaatacgccctggttcaaccgagcggcagtgaccgtaagtacgtggtcgcagctagcctgctgggcgatttagcccagaagtttaactggaccgactaccaggtggtcaagacctttaagggtgccgaaatggaagggatgaccaccaagcacccatacattgaccgtgagttgttagttggcctggctgattacgtcactgatgacgccgggactgggttggtccacaccgcacctggttacggggatgatgactacaacttcgggaagaagtacaacctgccgatctttgccccaatgaatgaccaaggggtactaaccgccgaaaacgggccggaatttgacggggtcttctaccaagacgccgatgatatttccctgcgcctgttagaggaacacgacgccctgcttttagaagaagacttagagcactcctacccgtttgactggcggaccaaaaagccgatcgtcttccgggcgaccgatcagtggtttgtctccatcgacaagatgcgcgacgaaatcttaaaggccgttgacgaagtgacctactacccgacttgggggaaggtccgcttgcggaacatgttaaaggaccgtggtgactgggtgatctcccgtcaacgggtctggggggttccgttgccgatcttctacgccgaagatggcacgccaatcatgaccgaagaaacgatcaaccacgtttccgacctctttcgggaatacggctccaacgtctggttcgatcgggaagccaaggacctcttgccagcgggcttcacctctgaacactccccgaacggcaagttcaccaaggaaaccgacatcatggacgtctggtttgactccggctcgtcgcaccaaggggtgttagccgaacgcgattacctgacttacccggcggacatgtacttggaaggttccgaccagtaccggggttggtttaactctagtttgatcacctcggtggtcgtttctgggcacgccccgtacaagtccgtcctctcccaagggtttaccttggaccagagcggtaagaagatgtccaagtccttagggaacgtgattgacccgaacaaggtggttaagcaaatgggggccgaaatcatccgcctttgggtaatgtcggccgacacctccgccgacgtgcgggtgtcaatggaaaccctgcaacaaatcgccgaatcctaccggaagttgcggaacaccttccgcttccttttggcgaacaccagcgactttggaccggagaactttgttgcctacgaaaagcgcgaagccgttgatcagtacatgacggttaacttcaatcgcttcctggccgggatgcgtgatgagttcgatcgttacgacttcttaaacgcctacaagcacttgattaactttgtcaacaacgacctgtcatccttctacatgaacgtggccaaggacgtcttgtacatcgaaccggaagactcccacgttcgccgctcgatgcaagcgaccttctacgaaattcttagcggcctgaccaagctgttgacgccgatcttgccgcacacaaccgaagaagtgtggtcctacatggatgaaccggaagacttcgttcagttaacggaaattccggaagcccggacgtttgaaaatggcaacgccctgcttgaaaagtgggaaggcttcatggaattacgttcccacgtccttaagtgcttggaagaagcccgtaacgctaagttgattggtcggtcacttgaagcgagcgccgacctgtacctgacggcttcccaacaagaattactagttgacctcgggaccgatgcgggactcttgtgtggggtttcagcgctgagcgttcacgacgctagcgaggcaccagcagaagccgaaagcttcagtgataacgcggccgtcttagttcaagcggccaagggtgaagtgtgtgatcgttgccggatgaccaaggaagacgttggctccgatccggcctacccgcaactctgtgcccgctgtgctaagttagtacgggaaaacttcccccaaacggttgaagaaggcttagaaaagtagtcgctacctggtgactggtgtaaaataggaacgaaagacgttgggcaaaccagcgttgagcgctccgtacaacaaaccgcttgcgctcggctgacgggcgtgggcggtttttgcgttggcgggggaaagtaggtgaaaagatgattcaagcaacgatcaagagttacgaccccaccaagggttggggctacattaccaccccacaagatggggatgtttactttcaccggcgggccattgaaggtcgcagccgggtcccaattcaaaagggacaagcagtcgagatggtgattgttcaaggccaacggggaccccaagcggcccacgtaacgattatgcaacgggaggattaagatggactttgaagaaaaagttactggacaccaaccggtttttagcggccatttgattgacgttgaggtccaagacgtgctgaccccggcggggaaccacgccactcgggaggtggttcaccacgccccggccgttgccattttggccctgaccgatgacgaccaaatgattttagaaaagcagtggcgggccccggtaaagcaggttaccctggaaattccggccggcaaagttgacgatcgtgaccaaggggacttgcgggcctgtgccgtgcgggaactcaatgaagaaaccgggctggcggctgaacaccttgatcaggttaacgcgacggctagttcggtcggcttttctgatgaggtaatcaccctctttgtggctaggggattacgcccggttgaccatgccctaccaaaggaccaagatgaagaattgagcctgttgaaggtgagcttgaaggaagccttagagatggtggccacggggcaaatcatcgatatgaaaacggtgatggccatttattactgggccagtcaacgggtgaactagatgcaagagccaaatgaagaactgagtcggcgccacttacgcaggcaagctggtgatcaagcggcaccggacgctagtggcgacgtgacgatgacccgccaggaaagcttggagctcgccaaaaaggagcgccaggagatggccactaggcagctcaagcggcggctcaactgggtgatcttgagtttagtggtagcgatcgtaattgtttatttgattctctttttcgttggttagaaaggaagtaccatgacatttggaattatttgcgccatgccagaagagttgcatgccctgagtgagcggttaactgaccgcaccgaaaccgtgttgggggggaaaacctacctagcgggaacgattgaaaaccaggcggtggtcctggtgaaatccggaattgggaaggtggaggccgggattacggccgaacacctcattaccgactttaaggtcgacgtggtcattaactccgggtcggccgggggaattggcgaggggctgcacgttggcgacgtggtgatcgcgacggaaacggcttaccacgatgttgacgtaaccgcctttggctacgaatacggccaactgccagcccagccggcccggtttagcgctgacccaacctgggttgagcgcattagtgaggccggcaaggagaccggcttaaacatcaagcagggcctgatcgtgacgggcgaccagtttgtgtcctctaaggcaatgattcaacagattaaggcccgctttaatgacgccctctcctctgaaatggaaggggcggccgtgggacaagtagccactgaccaccaagtaccgtacgtagtggtccgggcaatgtctgataccggtgacgagaacgccggggtgtcctttgatgaattcatcgtcgaggccggcaagcgctcggcggccatgctcttgcaactctttgctgatttgaacaagggaggggtggcgtaatggtgtaccaagcatccgttcaagtgcccggggaccaaacgacctacgcaattagccctaacattaagaagtactccctgattgacctaggttttgaacaaacccgccagggcaactacaagtacaccggctccctagaccggaccaacccctttaagccggccgccaagctacaaatcaccgttaacgccgaattaacggggtttaagatggatacggttagtgccaatggcttgcgtaagatcaatatcttcaccgggccgcgtagcgaggaatttgtgacccagtaccacttcatccttgatgaaatggtggccagggagattctgaccaaggcaagttagtttgatagcatcccgggcgtgtctttggtacaatggtaaatactggacatgcgaccttcaatcgtagatggatccagaatctattatgaaatgatggtgattttgcatgactgataacagtcatacccgcgttgtcgtcgggatgagcgggggcgtagattcctccgtgaccgccttgttgttaaagcagcagggttacgatgttgtcggggtttttatgaagaactgggacgacaccgatgagaacggggtttgtaccgcaacggaagactataaagacgttgccaaggtggcaacccaaattgggattccgtactactcggttaacttcgaaaaggagtactgggaccgggtctttacctacttcattgatgaattcaagaaggggcggacgccaaacccggacgtgatctgcaacaaggagatcaagtttaaagccttcatcgagtacgctaaccagctcggggccgattacgtcgccaccggtcactacgccgacttaaagcgcgacgaagccggtaacatgcacctgatgcgggcaaaggatcaaaccaaggatcagacctacttcttgagccaactcgaccacgcccaattggacaaggtgctcttccccctggctggttacaccaaaaaagaggttcgtcagctagccaaggacgccggcctcgtggttgccgacaagaaggattccgtggggatttgcttcatcggtgaggacggtcacttccgtgagttcttgagccagtacttgccggcccaacaaggtgaaatgcaaaccgttgacggtaaggttgtggggactcacgccggcttgatgtattacacaatcggccaacgcaagggcctcggccttgggggaaccaaggagaacaacgacccgtggtttgtgatcggaaaagacatcacgaaaaacgttctctacgtggggcagggctacgaaaacgagcacctttacgccacccacatggaggcttcggatatccactgggttgacgacgtggtcagccgctacgggacggagtttcactgtaccgctaagttccggtaccgccaaaaggacgaaggggtcaccgttaagctgtctgacgatggtcagatggtgaccgtgaccagtgacgatcccgcccgcgccatcacgccgggccaagccgtggtcttttacgatggtgacgagtgcttagggagtgccattatcgaccgggcttacaaccaggagcgtcaactgcaatacgtttaaactttaagcgaggctggggaaagaattccctggccttttttgcattccattttcaaagaccaccctcgccactcttacaatttagcctgtattggaggttggctcgcacttccgataacgtgctcccaaccacggacctagtggctaagtacggccggagaacgatgcgtaccgcatcaacccccgtcctagcttagcccaacggtccgtcgagaaggttggctcacacttccaataacgtgctcccaaccacggacctagtggctaagtacggccggagaacgatgcgtaccgcatcaacccccgtcctagcttagcccaacggtccatcgagaaggttggctcacacttccaataacgtgctcccaaccacggacctagtggctaagtacggccggagaacgatgcgtaccgcattaatccccgtcctagcttagcccaacggtccgtcgagaaggttggctcgcacttcttttagtggacagcgctttcttttacgactatcctataagaaaatcaatgaagggaatggtggccatgacactgttgacgaacggacgaatttttctgggaaccggcgagaatgactttgctaaggacctgcgctttgcggatggaaaggtcgtggaaacgggggatgatttaaaaccggctgaaggggaagaagtgatcgatgccaaggggcgcttggtgttgccggggctaattgatgcccatacgcaccccaaatacatcgccgacgcccttcacggggtggcttgtacgccgcctgacgtaaatagcattgcggaaatgcaagcggcgttgcggcattccccggcctttggtgccggtaaggacgtctggattgagggctggggctttgacgaaaccaagctcaaggagcaccggtccccgacccgggccgatttggaccaagtctcgaccgaccagcccatctttatctaccgttctgattgccactcctcagtgggaaactcccgggcgcttgagttagccgggattgaccggaccacccctgatccagtggggggcaagattgaacgcgacgatgccggggagccgaccggctttatgcgcgaggtagccgccacccaactgctaatccgggccaagtcggcgcagagttaccaagccgacgtggacaacctggtccaaagctctcaccactacctagccaatgggatcgtggcgatcggtgagatgatgggacgaaaaaagccgtatgattcctggcaactctatacggatgcggttacccggggctttttaccccggacgaccatttactacgtgtttgacgaattaaaggacggcgccgctctgtcattcaaagccactgaccagctaagggtggccggcattaaggtcttcatggacgggagcatttcgggggaaaccgcggataacacccgcccctacccggatgggaaacggggggtcttgttgacggatcaagacaagttgcttgcggccgtcgagatggccaaagcggccaaggtgcaactagcggttcacgcaatgggggacgccgcgatccagctggttttagacacgactgctaacctaaccccgtggctcagcgagaccccctcggtgcgaattgagcacgcttcgctattgaccgacgccatgtttgaccagattaaccgggccaagatgaactacggcctggttacccagccaatcttctttttcgctgaggtggcgtcctaccaagccttcttgactagcagccagtaccaagaaatctaccgggttaaaccaatggaacgctccaaagcgctggttgcactaagttccgatgcgccctgcaccccgtgggcggaaccggatagtgtcttttacagtctctacgcagcggtcaccaggagggcggctaacggggaggtagttggcccagaagaagccatcacggtgggaacggggctgttagcctacaccaaagacgccgcgttgatgggcggctttgaggaaaacggcaccctggtggcgggcaagaacgcggactttgtcatcgtggatcaggacctgtttaccatcgatcctaccgagattaaggacacccgggtcgccgaaacctgggtggctggccaacgggtttatcaacgtgcggtgggggaaggtaactaatttagccaaagttggtttgcccccttgtcagctccccataaaaggggtattatctaagacatccatgagaatgttagaattagattagaacgatgggggtaaggcttatggcaagaacagttgggatcatcggctccgggcacgtgggagctaccttagcaaacaatttattagtcactggtagcgtggataaacttgttttgattgatacaaatgagctaaaggtcaattcagatgcgacggactttgaagacgcccttgccaacttgcccacccacactaaggtggttaaaaataactaccgggagttaaaacacgcggacgtggtcgtaatcgcggttggttcaattggggttcaaaatgacgacgccaagcacgaccggttcgtggaattaaaagtgactagcaaggcggccaaggaggtggggaccaaactaagggaggtcggcttcgatggggtcttggtttcgattagtaacccctgtgacgtggtcgccgccctctttcaacactacaccggcttgccaagggatcaggtaattggcaccgggacactgttagacacctcccgcatgaagaaggtggttggccaacgctttgaattggatccccgttcggtttctggttacaaccttggggagcacggaaattcgcaatttacggcctggtcccaagttcgggtcttggatcagccggtgaccgcagcgctaagtgaagcggagttggacgaactggccgaagccgttcgggcggggggctacacggtctttcacggcaagcactacaccaacttcgggattgcggcagcggcgcttcggttggtcaccgccatcataaatgatgcccgtgccgagctacccatctccaacttccgcgaggagctaggtacctacgtgggctatccggccgtggtgggaagcggtggggtcgttcgccaaccccaactgacactcaccagcgcggaaaaagaaaagttattggcgtcagcaaattacatccagacccgctatgaggcggtcctgactgaattagagaagtagaaaagaacgcagggctctagcgaacggtgctagggccttttttagtaagccgggacgtaggtggttcatcccggacgggaaaagacggcggaattcaaaaggaaacccaattttttggtttgtgattttcactcacccggcgatctttggtattatagataacagagaattgttgttagcaaattaagagagcttttttgaggcaaacatgacaaccatttattttattcgacacgggaaaacggagtggaacctggcggagcgctaccaaggggcgcacggggattcaccactcttagaggcgagtcatcaagacatccgttctttagcggcgtcactggcgggggttaagttcattcacgcctacaccagtcccctaaagcgggcccggcaaacggctgaggagttgatcgctcagttgccaacaccagtggccctaaccgttgatgaacgcctgattgaatttgacctcgggaagatggagggaatgacattttcagccgttgaaaaagagtggccgaccaccgtcgataactttcaccaccatcccgagcggtttgacccaacggtggtgggcagcgagtcctttgaggcggtaattgaccggctcaaagctgccgtcctcgactactgtcaccgctacccgcgggggaatgtgttagttgtctcccacggggcggcgttaaatgccggcatcaacggaattttaggcgcctccttagtcaacctgaagcaacgcggcggtttatcaaacacttccaccacggtaattcagactactgatcaaaagcactttgaactcgtcaaatggaatgatacggagtacctgcaccggacgcaggtggacccaacggacacggtataacggggtgaaactaaatggaaaaagaaacgaagcaacaagaagcacaaaagcgtcaatcggaacaactggtgcaccaattggtggccgctattgacgccgaaccaaacaagtttaacaattactacgagctcggctcccttttgacccgcctccacgattacacccaagccgaagagctgttcttaaaggcgctaggcctgtttgaaacccgcggtgatgaacgggcggtaaccttcttaaagtatgggttagggaacctgtattacgaagtggaccaagtcgataaggcgatcaagtactacaaccaggttgaagacgaaaagatgaaggccgatgcttacttaatgctggcccagtcatacgttaaaaagggccaatataaacaggcggttatgtacggcttgacggcccacgagttagaagaaagcgacccagaaatcagccaggtgctgggggatgccctcttggctctgggcgaatttgagcaggccaaaaagtactacgaccggatcttggttcgccacccgggccgggccgacacccaatttgaccgggggctggtggccatggcgcttggtgaaccttaccaaccgtacttggaacaggcccagcaactgaacccggattactacaagaagagcgaaaagcggattgccgaaatagaaaagaccctgcaggaattaggtgacaaggggggccactaaatggcgtaccgggattatacccagccggtaattcatgacgaaaaggtccaagaaacgggaccaacgcatttttcggggcgggtacgaaaagttatcttttctaacccgccctttgctattttagcggtgacggtgttaaaggctgactttgagtgggacaccgaagaaatcaccgttaagggtgacgttggtcaagttaacgagggcgatgagtttgaatttgagggtcaggttgtcaacaacccgcgctacggctttgagtttgatttttcgggttttgtccaccagctgcctcacgacgccaaggagctggccgcctttttaaagaagaacaacgtggcggtcagtgatgagaaaaaggtggccaaggccattgatgacgccttaggcgaaaaggccatgagcaccctgattggcgacgccgacgcaatcgaagtggtgtccgggttgagtcaaaaagacatcgcgaccttaaagacctttttcaaccggttggtcaaagatgacgaggccagcaaggccaaccgccagttgatgatgctcggtttctcggcctggatgatccgccgcttgcaggaattctaccaacggcggttgcttaaaatcctcgaagaagacatttaccaagtggtagccgattatgagcagttggggattagttttcgcccggtggatgaggcggcacgccagtatcaagacgtggccttcgatgatccccgccgcatcgatggggctctcctctttgccgcccaaattctgattcgggaaaattccggctcgtacgtcgccccgcaattactgttgaaccgggctagccaactccttaaccagggcgccaccgtcagccaggataccctggcggcgcgtttgggaattttactgacccaaaagaagctttaccacgtgcccgagcggggaatctacccggccctgttctttcacgccgaaaatttaattgccagtcagcttcaccagatgatggcggcggcccagccggtcagcgccaagcggcaaaagctgattgaaaagatagttgatcaggtggccaaggaacaaaaaatcacttacgacgaccagcaaaaggcggcgattaaacaggccttagaagcaccggtgctgctcttgaccgggggaccggggaccgggaagacgacgattctaaacgggatcgtgcgggcataccggcgcctgttaaaagaggacggccaaaagctccacgcttggagcgatggggaaccaattcagttagttgcccccaccgggcgggcggctaagcaagcccgccaggcgatcacgggtgagggcgttgccgcgtcaaccatccaccacttcttgagcattgcaaccgataacgatgccgcccgtttgattgaaaaaccggcgcccctagaaaatgccggtcagatgctggtggttgacgaaatgtcgatgacctccaccctcttgatgggggggctaatggcggtgatcccgaccaacatccacttagtgttagtcggtgacttcgatcagctgccgtcggtgggaccggggcaggtgttccgggacttgctcgaatctaattgcttaccgcaagtccgcttggaacggatttaccgccaggacgccgattcctctttgatcccgttagcccagcggatcaacaagggggacgttgacgaggacttcattgcccccaccccaaagactaagtaccccaagcgaatctttgtgaccaccgccgctcgcgacgttccgtcccggattggtcagctagtcgacgcctacttgggtagtcacgacttggatattcaagatattcagatcttaaccccgctacggcgccaccgcgacctgattaatagctacttgcaagaccacctgaatccggccagcttaaaccaggccacttaccggttacgaagccgggagctacgggtgggcgacaaggtaatgcagacaacgaacgactccgacgccgaggtttataacggtgacatcgggatcatcaagtcgattgccgggaaagataagcacgtcgttaacggcgatcggctcgccaaaaaggagaaggtgcacctgaaggtcacggtcgactttgctggccacctggttaaatacgatgaccccaccgccctggctaacttagaactggcctacgcgatgacgattcacaaggcccaggggagtcaggcgccggtcgtgattgtgaccttgctgtcggagtttttcccgactaacccccaggctggttcaatcatccaacgtaacctcttgtacacggcagtgacccggtcgtcgcgggctctggtgatggtgggtgacgccccggccttcgtgcgttgctctaagacgccggtggtggaccgccccacctctctcaagcagcgactgaagttggtttggcaagcagcccagcaggatccagactccccggcagacgagaaagcccagacgccggttcaagaagaacaaccagcggatcacttgacgccggcaatggtggaagacgaacgggtggacccgctgatcggcatggatggattaagtccggccgactttgcctaatctggttgcaagccgggcccaaaattgtgataataggaaaaacgtcactaacaacggaaggacaaagacgatgagtaaaatcgaaaatgccgaaaacgtatccctctttgcgctaaacgcaaaccaaccgctggcccaagcggtggccgatcaggtgggaattcccctttcaaagtgcacgattagccactttgccgacggggaaatttccgtgacgatcgacgaaagcgtgcgggggcgggaagtatacgtaattcaatcgatttccgagccagttaacaccaacctgatggaactgttgattatggtcgacgccctgcgccgggcgagcgccaagaagattaacgtggtggttccgtactacggttacgcccgccaagaccgcaaagcccgttcgcgggaaccaatcaccgctaagctggtggccaacctgctgacgatggatcaaatcgaccggatgatcgtcgtcgaccttcacgccccgcaggtacaagggttcttcgacatcccggtggaccacttgctggccgccccaaccctggttaagtacttcatggacgaggggattaccgataacttggtgattgtggctcctgaccacgccggggtgaaccgggtccgccggtttgctgaattaattggcggcgccccgatcgcaatcgttgataagcggacggaaagtaaccgcgaagcccgtcacgaacaattaccaactacggtgattggggaagtggccggcaagacggcgatcattgttgacgacattgtcgatactggttcgcggattgccaactccgccaccctccttaagaagtgtggtgccgaccgggtctttggggttgcgacccacgcggtcttatccggggacgctagccagcgcctgttggattccccactggagaaaatggtggttaccgatacgatcgtgatcccagaagagaagcaaacggaaaacatcgaacaactttccgttgccccgctactcgctggtgccatcaaccggattcacaaccacctttcaattcacgatctcttccaactgccggaagaaggctaataaaaaaactcgcccgcgggcgagtttttttattagattaattcggtttgtacctgtggggtacccttctttaagttggccaagagccggtttaattcaagtcggcgttggtgcttagagatgaaaacccccatcttctcttggtcaaagccggtcaccatcttgtggtcgttaaagatgatcgggttgcgcaagatgtgcgggctcttttcaattgcttgggcaagttggttaatggttagattacgggcgtccatttgcagggccttggtatcatgggagcgtttagaaattaaatcgtcggtcccgtccgtggaaagggagagcaggtcgaggatttcaggggtcgtcaacggctccttttcgatgtttcgttgactaacggtgatcccgtgctgagttaaccattgaacggctttgcgcttggatgggtcgttagtgtggaaaaataaattgaccatcgaatcactcctttgtaagcttttagacatgtaagcttttagacattttagcagttttccttggttagaaacgctaattgactggtaattaatgaattctttagcactcattagtaattaattataaattactttgttcaattaggtgttagaacagaagggcgggtgctaaggaagtgaatatgtatattatactgcgataactaaaaaaagtcctgtcgttggacaagactttgactttatttaacctttttctttttgcgtaagtggcgcacctggcggaaggggtaagaagcggtccccagttccaggtcaacgaagcggttacccatttcctcaccgtcaacttgaccaaactcaagcgaggtggtggtgtagtgaaggtgggtgccgacgaagcggtgggcaaagcgggaccgggccaagtgttcccgtaagaagagccacatcgtccagaaggtaatcagccagttgtggcgctcgacgactaacaactccaggttgggttcggcgaggtcacggtcgggagcgaccttccgcccgccaccgataaaggggtggttagaggcaatgacgataaaggcgttagggaagagctggcgggtgcgctcttgttggaccatcagggtgaagggggcttggtcatataagacccccagggcctgggaaacgtaggaaaaggcccctaagtggagccggttgaggcgccgcttacttttcgaagcgttggtccggctgaccacggcggcgtcaaagccgatccccaagttatttaaaaagtagccgtcttcgtttttaatggcgtcgtgatagtggccaatggtgaccggttcggtagtttcggcatccaaaatttggtgcagggcggttaacgggttggttgagattccgtaaccacgggcgaaatcgttaccggttccgcaggggatgtagccaattggcagtgggtgttgccgaccgtttttgctctgcaagaccccgttaaccacttggtgtaaggtaccatcgccaccgatgacgatcagggtttcgtcgggccggccggcatgccggtcggccaggcgcatcgtgaggtaggtggctccttcctcgtccctggtaaacaacggggtgtagtcgagttgggctgcgtctaaggcagccttaacggttgaccatgttgaattcccccggcccccgccggccacggggttaataatgatcgagtaatgcatagtttcctccggatcatcaagaaagtgggtgggaaataacctccgctgcaggtcgtatgactaagctaggacgaacggttggtgcgggacgcaccgttcttcggcctgcttaggcactggaactacggtcatttaccacatttctgtctaacattcgtgaatacaacaagaggccgggaaaaacagagttttttcccggcctccgttaaacgcgaacagatcggcgccgcagggttaattaccgtgggccgtttaacgcttaaaattcagttaactggaagtccgcgttgttttcttgttcgtaggccagtgccttttcatccaacagttcgataaattcaacgttgtagttggtgttttcttctactaacacgcgggcagcggcttcggaatcggcttccaggtatagggattgggtgttttcccgacgcggggtcgtgtttttacttggttggtaataaactttgaaagtcatgtcatgctcctattcatttgttcgtaaattttacctaactatgatagcacacttgcccgggactgtccttaaatttccaactgtgctatcctaagctaagaaaaggtttagaaagtggggagtgcgatgaccctaatttggagtatcctgattgccttcgcagtggtggtcgtaatttatcaactggtgcaccggactttggttaagcgcgccacgatcatcatgcaaaaccaagcccaagcggccaccgatcaggccgtacaagccgccctaaaggcccacctccgcccggccaatttaccaaccgactcggtgatggtggccgacgtttggggaaagggcgtcatggcctttgagtacgtggtcgacatgccacagctaaacgtcgaagaacaagagtggctgaccaaagaaaatttgaccacggcccttgatcaggtgggggccccaacccccttggtgattacagactggtgggagtatgaacaccaactgcacgttgacgtagccaacttaatgaatgaagcaaccaaggaatacgtggccgacctagaaaaattagataaggcttagctggcggtaggtttttacggtagcttggtcaaattaaaaagcccgtcccgcgaaatcgcgagggcgggctttttaatttaaggtcataacgaattacgcccaattttaaccgaagaagacggttccttcgggggcctcaaatgggttgtccttgttaatgtgatcgtagaacagcaccccgtggaggtggtcaatttcgtgttggcaaacgatggcggggtagtgctttaagcggaccttgtgcgtttcaccctggacgtcttggtacttgagggtgatccggtcgtgacgtggcacgtagccggcgatgtcgcgatcaacggagaggcaaccttcgccttccgttagcgcccccatttgtacggattcggaaatgatgaccgggttgatgatcacatccttaaaaatcggggtgtcgtcttcttcgtcgtcggatggcaccaagacggcggccatttgcttgctgacgttgacctggggagcggcaaggccaaccccggcccgcaacccgtacttttcggccagttcttcatcttggctgatttccaagtattccattaggtccttagccaattgttgttcttcttcggtcagtgggaaggacaccttggcggcgtaatcgcgcaggaccgttccctcctggtcgtctctgacaatgtctttcattaaaatcattggtggatcccccttgtctctaattgctattttctagtttagcacaatcaaaaggggggacggcaataattacctccggggcaaatcatgttaaaatgagagcaaattgattaaaagggtgatgtaaatggcaataaacggtggaaactattcctacccattagacccaacgtggacggcggaagaactgatcgccgtgactaacttctaccgggtcgttgaggacgcctacgagacaggggtgcggcggcaacgggtcctagattgctaccaagcgtttaaaaaggtggtccctaccaaggcccaagaaaagcaacttggccgcgatttttaccgggtctcgggctaccagtgctacgacgtggtcaaggcggccaaagaaacgaccaaggggcaacttaagatcggggggtaaaggatgttagaaaaaattgatcaagccgttttggacttgttagatgaggtgcgtcaccggaccctcaaccggatgcaggcctcttatgacatcgatctaaagtcctcgtacaaggatttagtgaccacggtcgacaaggaaaacgaccagtacatttcgaccaggttacacgaaatcgacccgggaagccgggtggtttcggaagaggggtttggcgatgaagtggccaccctgactggccacgtctggattgtggacccgattgacgggacgatgaactttgttatgcaacacgccaatttctacatcatgattgccctctacgttgatggtaagcccactttgggttacatcatggacgtaattgacgggaccgtctaccacggcggtaagaagcggggcgtctttgaaaataaccggcgcctgacgagcccggccaataacggcttaaaggatagcttggtggccctcaattcagcgatgattttaaacaacgcccataacctgcgtgaggtggcccaccaatcccggggcctacggatgtacggggcggctggaatggaattagtttacgtcctcactggccagttgggcgcctacctttcctacttgcacccctgggacttggctgcgggccgggttttggcggaggcaatgggattagtggtcaaagcgattgacgcaccttccattgatgtgttatcatctaaccttgtattaatagcgacaaaacaagcggccgatgatgtcttagcccttgtcaactagccgataactgtgacctcggtcgcagtttttttaagagaaaaaagcggtaacgcttggaaacgaaaggaagataaatcttgaaaacacgtgacgatattcgcaacattgcgatcattgcccacgtcgaccacggtaagacgaccctggttaacgaaatgttgaagcaatcggataccctgccggaacactttgaaatccaggaccgggcaatggataccaacgccattgaacgggaacgggggatcacgatcctctccaagaacacggccgttaagtacaatggctaccaaatcaacatccttgatacgccagggcacgccgacttcggtggtgaagtggaacgtgttatgaagatggtagacggtgtcttgttagttgtcgatgcctttgaagggacgatgccgcaaacccgcttcgttttaaagaaggccctggaacaacacctaacgccgatcgtggtgattaacaaggttgaccgtgaaggcgctcgcccggaagaagtggttgacgaagtgctcgacctcttcatcgaattaggggccgacgaagaccaactggacttcccagtagtttacgcctccgctatgaacgggacgacgtcattagacgctgacgttgccacccaagaacacacgatgaagccgttatttgacacgatcatcgacacgattccggcaccaatcgacaactccgacgaaccactccaattccaagtggcgatcctcgattacaacgacttcgttggtcggattgggatcggccgcgtagttcgtggtcaaatcaaggttggggaccaagttacggttatgaaactggacggctccaagcaaaacttccgcgttaccaagctcttcgggttcgttgggcttaagcgggtggaaattcaagaagctaagtccggtgacctgatcgccgtttccgggatggatgaaatcaacgttggtgaaacggtggttaacccagaacacccggacgccttaacgccgttgcggatcgacccgccgacgttgcaaatgaccttccggaccaacgactccccgtttgctggtcgcgaaggtgaatttgtgacttcccggcaactggaaagccgcctgaagtctgaattacacaccgacgtttccctgcgggttgacgacactgatgacccgggtgcttggaccgtttccgggcgtggggaattgcacttatcaatcctgattgaaacgatgcgtcgggaaggttacgaactggccgtttcccgtccgcaagttatctaccgcgaagtcgacggggttgaatgcgaaccgtttgaagaagttcaaatcgacacgccggatgaatacactggttcaatcattgactctctttcccaacgtaaggggcaaatgaagaacatggaaccatccaacaacggccaaacccggttgatttttgaagttccatcccggggcttgatcggttactccaacgaattcatgagccaaaccaagggttacgggattatgagccacgtcttcaaggaatacgctccggtggttaagaactggaacccaggccgcaagaaggggaccttggtttcgatgaactctggcaaggccacgacctacgccatgatggggatcgaatcccgcgggacgctcctgattgacccagggacggaagtctacgaagggatgatcgttggtgaaaacagccgcgaaaacgacatcacggttaacatcaccaagggtaagaacctgaccaacgtccgggcagccggttccgacgacatggcccggatcaagacgccaacgcacttgtcccttgaagaatcccttgaattcttaaacgacgatgaatactgcgaaatcacgccggaaaacgttcgtttacgtaagcaaatcctggacactaacgcccgggaaaaggcggctaagcggcgcaaggcagccttgcgtgacaagtaattaataaggctttcttaacggccgtgacaacatcggattgtcacggccgtttggtgtataattagaccacgattgtcgtgaaaatggggtgaatttaagtttatgaaaaaccaagccaaacgccggatctccacttgggacccgtggctattagtgccctttttatccctgtgcgtattgggggtggtgatggtgtattcagccagtgcggtggttcgctaccagtccgaaagtggccccttctcctacctccgtaagcaggccatctttgctgtcttagggctgttggtgtttatgtttgtttcctcagttgatattaaaatgtttcgtagtccggggctcttaaaaaacttcgccatggcgatgtttttgtctttgatcggcgttaagctgtttggggcctcgatcaacggggcccaagggtggatcaatatagggggggtcttttcgatccaaccggccgaagtctgcaagctctttttgatcttatacttagctagtctctttaccgattaccgcgagcaccctaagtcgtttagcaagtacgcgtatgcctttccgatgacggtggcggctgttttgattgttttaatcgtcatccagcccgaccttgggggggcggcaatcaactcggcgatcgtcttaatcctctttttgagtgccaagactaagtggaagagcggcgtaacggtcctcgtttcggtctttttaggggtcgtatttggaatgccctttgtctcggagctagccgttaaatacattcatggctacaaggccgcccgcttcgtcggctacctcaacccctttggctctacttccggggccggtagccagttggtaaactcctattacgccatttcaaacgggggtctgtttgggaaggggctggggaactcgattcaaaagatggggtacctaccggagccaaacaccgactttatcttggccgtgattgccgaggagttggggttaatcacggtgattttaattctgctggggctaggcatcattgtctgccggacgattcagattggggcccgggcgactaaccagtacgacacgctcatttgttacggggtggcaacctttatcctggtcgaagcctcctttaacattggggcggtctgcggtctgttgccgatcactggggtgaccctccccttcatttcctacggggggtccagtatgttggtgctttgttttgccctcgggctggtctttaatgtctccaggaggcaacgggcccgccggtctgcccaacagagccaagtcaaggaaggggtgctcaatgcaaatgcctgatgaacaatttgaattggtaccccgccgggggctcgccgtctacattagcagccgccgggtgattcgggccctccgtcactacggccgggtccactacgtttccaagcgggcccactacgccattatctacgttgacgaggcgcaggtcgcagaaacgattgaacgattagagaagctgcataacgtcaagcgggtggtgccgtccgccttaccagatttagatccggacgtggccgaccttgcgtcgacgggactatacaaaacacacgatgaggatgattaacgatgagagttgtggcgggtgaataccgggggcgtaaattaagcgcggtgccaggaatggcaacgcggccaacgaccgacaaggtgaaagaagcggtgtttaacatcattggcccctactttgatgggggaacgtcactggacctgtacgccgggtcgggtggcctttcgatcgaaggggtgtcacgcgggattgaacgggccgtcttggttgaccgtcagctagcggcgatcaagacgatcaagaaaaacattgcgaccactaagcacgaggaccagtttgtggtgttaaaacaagacgccacgcgggccctgcacatgctacaaagtaagggtgaacactttgatctaatctacttggacccgccctatgcgaagcagcagatcgtaactgacctaacaaaaatggtagaattggacttgataaacccgggggcaatcgtggtggcggaaaccaaccaggaggctaaccttccagaacagctccccggcttttcctttaagcgacgccaagattacggcatcacggtggtgaccgtgtaccggtatgacggaaaggagtaagaatatgaaagttgcaatctttccggggagttttgatcccctaactcttggtcacttggatttaattaaacgggggagcgccctttttgaccacctggccgtggccgtgatgactaacaccagcaaggatgcctggttcacggtggatgagcgggttgcccaagttaaagaagcggtcgccggcctggacaacgtttcggtgatcaccgctacgggcttaaccgttgacctgatgaacaaaattggggcggattatttgatgcgcggggttagaaacgttgacgatttccgttacgaaaaagacatcgccgcaatgaatcactacctagacgaccaggtggaaacgatcatcttcttagcggaccctaagtaccaatacctctctagtagcctcttaaaagaggtcgccatgtcggggggcaacatcgccgccctcttgccggccaatatcaacgaggcgttgcaagcgcgcctggaaaaacggcaaatgaagcgggtaaaaaaagagaatgaagaagcaagataatcaaatactgcgccggattggggtaaccttagccttaattttatttgcctgttggttcttattttggccactcaacctctacatcgaaagtccggggtcggcggatagcctcaagagctacgtgacgatgaagaatcaccccgataagtacaaggggagctttatgatcacctcggtctacctccagcaggcccgcccggctacgtacttgtgggccaagttgaatccacatacttccattgaaagtgccgattcggtgaccggtggcgaaaactcggcgacctacaccaaggtccaagacttttatatgcaatcggcgatcaacgaagcaatcgccgtggcctaccgggctgccggccagcaatacaccaagaagtacctggggatttacgtcttatcggttcagagcaactcggagtttaaaaagcagatccaagttggcgacacgattaccaaggtgaacgggcgccactttgacaccgccgctggctaccaaaagtacattgccagccaaaaggtgggcgacaagctgacggtaacttacctccacaacgggaagcaaaaaacggccaccgaaccgttggtcaagatctcgaccggtaaaccaggaattgggatcatcttgaccgataacgtcaaggtgaccaccaagattccggtgtcggttaaccccgggcagttgggcgggccgtccggtgggttaatgtttagcctgcagatttacgagcagttgacccaacaagacctccgtcacgggcgaaagattgccggaacggggacaattggtgcggacggctccgttggtgagattggcgggatcgataaaaagatcatcgccgccaagaatgccggggcaacgatcttctttgccccctacgtgaaaccaaccaaggagatcctaaagtacgaagaaggccacaagactaactaccagctagcaaaggaaacggctaaaaagtatgccccgaacatgaaggtagttccggttcagacctttgaagacgcggttaactaccttaaaacccaccaataaaaaaacgatcaggttttttcgtgacctgatcgttttttttgcgtacttaggggtgaagggaggaattgacggtggaaaaattagtcgaacagctccaggccctgtgggaagagcaccgttcacaaatctacgttgtcatcggcttggtgctagcagtgggtttttggtggtggcatacccaccaaccggttaccgacgcggtaggggcgactagccagtcgagcgcctattcggcaaccagtgcggtgaccagtagcctagcaactagtaccgaaaacggttcggggcgggtgtgggtggacgtaaagggggccgttaataagccaggggtttaccacttgaaaaagggggcccgggtgcaagaggccatcgctgcggcggggagtcagacgtctttagccgacttaaaccaggttaacttagctaaggagctccaagaccaacaggtcgtgtacgtaccggcccaaggagaaaaggtggcggatgcgacgacggcgaccaccgggactacggacgccacgagcgctacgagccaaagcggtcagggtgattcggttaacctaaacacggcgactaaagagcagctgcaaacaatcgatgggattggtgacaaaaaggcggataagatcattgcctaccggcaggaacacggcggtttcaagacggtcgaggacttgaaaaacgttgacggctttggcgataaaacggtggccaaaatcaaagaccggctggcggtttaggcatgacccagaaagtttgctatactagtgggtgacacttaagggggtatcaaaatgaaaaaaagaattgattgggaccagtacttcatggttcaagccgccctgttggcatcccggagcacttgcacccgcttgtcggtgggggccgtgttggttcgcgacaaacggatcatcggctccggctataacggggcggtggctggtgatgagcactgcatcgacgtcggttgttacctgcgcgatggtcactgtgtgcggacgatccacgcggaaatgaatgcccttttgcagtgcgccaagtttggcacctcgacggacggggcgatggtctacgtgactgacttcccgtgcttgcagtgcacgaagagcctcttacaagccgggatcacccaaatcaattacctccgtaattaccataacgatgattacgctatgaagttgattgagctaaagggcgtcacccttcaccaaatcaaactagacgcagatatcttagaccaggttaacctcgaccaatacattaacccggactaaatggcttctttgcggggcctgttcttggcccttgctgcttccctgaccgccgcttggttaatcggccaccaaaactgggccgcggtggggttgcttcttttattcggccgggtactttgccagcgcgaccgccggacaacttggctgacggttggggtgatcgtgatcatcggcttacggtgtgggcagctacttgctcagcgccaggcacaaacgcagctggctggcgactttacggggcaactaacggttcagcccgacgcctggcgaattaacggtgacctggcttcggcggttgccgttaccgaaagcgggtctaaggtgcaactcttcttaaccctccagagtcaggaccaacaacgtcaacttcaagaggtgactaccccggtaaagctgaacgtcaccggtaaggtggaacaaatcttaccggcaactaacaccaacgaatttgatcgaagggcctaccaggccaaccggggaatttataaccaggtgaccggggaagccccggtcttggtagcccaagcgtcacaccgcctaacggactttctgcaccagttgcgggccaactttagtcaccacatggctaatttaccccagccgctagcggggtactgccggcggctgttgattggtgaacatgatccggcgaccgccagtgagatggtagcggtcaagcaactggggatcatccacctgttttgcctgtcgggtttacacctggtggttttgtgcggggtggtccgcggtttgtttgcacgcctaggcttgactaaggaaaccagccgggggttattgttaatcctcttgcccctctactgggtagtggggggcggttcggtaagcctagggcgggccagcatgatgatggagctacagttattaggacagttggttggcctacggggaatgctcccttgggcgatcagtttgttaattcaaaccctcatcagtccgagtatcctcttgtcaatggggggccagttgtcctacctgctatcgttttgcctgacctggtttgagcagcccagtggcctcaaacagaccctgcgcctttctttggttagcttgccaccgctcttgcattcggtttaccaatttcacttactaagcctggtcatcaactacctgatgatcccctttttctcgctgatcatcatgcccctggcaattggcgggggaatcttgtacccactgtttccaggcttgggagcggtggtcaacgccggcctgatcttatttcaccgggggttggccgccttggctaaccttcccgggacgattacctttggcaaggtacctgcttgggtagcggtgagcttagttttattaacgatggtgacttgggaaaagcggggcgccgttaagtggctggttctcggctacgttgtcacctttgtgtggctccattttcccctacaaggtgaggtcaccttcgtcgacattggtcagggtgattgcattatcatccgtgaacccttcaaccggcgggtgatgatgattgataccgggggtaaacttaactttcaaacggaggggtggaagaaacgaactaattcggccactgataaggccaccagcacctctttaaattacctcaaaagcgagggaattgatcacttggacgcggtgtggctgtcgcacagtgatgcggaccacattggctacctaccaacggtattaaccagcatgcgggtggagcgcctctacgtcccagcgggaatggaaaagatgaccaagtttaccaagcggttgccgagcaacactaggacccagattataccgattaccagtcaagcgccgggctttggtggccttaccatcctgcacccgtttacgccgggggaggccaccaacgatgattcggtcgtcttggctggcgagtttggcggtaagcggtttgtgtttactggcgaccttccccaagctggggaattagctgttttggcgcattacccgaatttaagggcaacggtggttaagcttggccaccacggcagtaagacctccagttcgccgacctttttaaagcaggtgggcgcccgggtggggattatatctgccgggcgcaataatcggtacgggcaccccaaccaagagacgttaacgaccctcgcgcaattacacatccaaacctattcaacgcaaacccaagggatgattacgtatcggtacaattcccggggtgggcactttattacccataacactcccgaacaacttcaattgagcaactgacagaaagcggtgatgacgtggacattcaagaactgagcaaacaactaaagcgggccaaccccgccatggtatacctagtgttgggtacgcaagcggtcttgcaacaggaggccaaagacgtctttttaaacctgatcccagaagaagagcgggtcatgaacgtcggtagctacgacatggaaaccacccccttggctgatgccttagatgatgcaatggcggcgcccttttttggggagcggcggctagtcattttgaataagccggcctttttgactggtgggactagccgcggggcgcttaaacaagacggtgaggtgctccgtgagtacttaaagcacccccagccaacaacggtgctagttttgttggccccctacgaaaagctcgatggccgcaagggggtggtcaaggaccttaagaagttggcggtcgaggtttcggcggctcccttagacgaaccccgggcccgtcgccttgttgaacagaggtttcaagcggatggttaccaactcgggcggggagccattgatgaactcgttcgccgcaccaacgccgattacggaaagatgatggccgccgtgccggtgattgaactagcggtttaccaagataagcgggtgactgatgcggccgtggccggtttagtcccccaatcactggacgaaaacgtctttgacctggttcaggcggtgttaaatcgtgagcaggtggaggccgttcgtttgtaccgggagctattagaaagccagcaggcccccttacaaatcaacgccattttagttagtcagttccgcttgctcttgcaaattaaggtattgagcaaccggggccttagccaggggacgctagcgggtcagttaaaggttcacccgtaccgggttaaattaggcttacaaacggcccggcgctttagcatggatgacctgtcccacgcatacttagggctgattcgttgtgagcgggcgttaaagtcgactcaacaggacccggagttattattccaactcttcttactccagtacaccaagcaaaaggtttcctaatgaggagagtggccaaggacttctgaggcaggtcggatgtaagcgtggacgagcgacctgcgtagtccggaccgatccgcgtcctgtagttattggtcgagttttaggcacgacgctaaatcttgtcggtggattgccatggtggtgattcgtcggcaggatttttcaagttttggggcacaaaaaacgcccccgccaaattggcagggacgtttttcttttattggctaaccgcgcttactttgcgtaacgggcggaaagacgtgacttgtcacgtgcagccttgttcgccttgatcaggcccttagagtgggcatggtcgatagcggaaatagcggccttgtataagtcgtcaaggttgtcagcacctgctaacttagccttgtcaaacttcttgatggcagtccgcattgcgctcatttgggaagcgttccgggcagcggccttttcatttacacgtacacgttcaatcgctgacttgataattggcatttcgatttcacctccgtcaccgtttggtatcagttgaccagaattttcaacttttttattatagcgaatctcacttttgaatgcaactaccagctagaagaagattccgacttgcaattgggggcaaagttaagtatagtggttaaggttatttaaccaagcttaacccccactcggtttgacgatcctcaccgacgtcttacctagtggcgggtcttccaaaatttgaaaggtgggaaacattcatggctatctcaaaggaaaagaagaacgaaatcatcaagcaattcgctactcacgaaggggacactggttcaacccaagttcaagtggctgttttgactgcagacattaacgaactcaacgaacaccttcgcgaacacaagcacgattaccactcacaacgtggtttgatgaagaagatcggtcaccgtcgtaacctgttggcttacctccgtcggactgaccttcctgcttaccgggaactgatcaaggcccttggtcttcgtcggtaattattttccagggtgcccagtttactgggggccattaatgaagatcgtaacggtttcgttgcggtctttttattttgacttttcacttgctaatgagtattcttatgagaaatcaattagagattaatgaaaactaattgatgagggggaatacatatgtttagcgagattggccaaacaatttttgaaaacgaagcggtcgctaaaacgttcgactttaacatgggcctggaagtagaaatgcaccgggctgataacatgggtgaattgagtcccgaaacgaccccggccagcattagtttagataatccgtggattaccaaggactttaccgagacaatgaccgaggtggtaacgccggcggccaataacgcccgggatgcggttcattacctatacagtctcaataacgccctgcgcaatgcgttagcgcccaatgaggttttgtggcccctgtcgatgccaccggcctttgcggacgcccaaaagattcagttggcaaagacaacgcctgaaaaagaagcctatttaaagcgggtgctagccaacatgggggcggtcaataagggcttgccctgtggggtgcacgttagtttgagcattgatgaccgggttgttaatatgatctgggagaagtaccagtctagatttaatagtaaagaagcggtcagaaatcacctctacatcttattagcccaagggttcacacgttaccggtggttgttaacctacctcttgggggccagcccggtggccgagcgaaacttctttaacccgggcgatccccaacctgaccacccggtgcgtagccttcgccagagccactacgggtttgatatgcgctttgctggtgactacaccaacgttcgccgttacgttaaccgggtcttggccggagttaagaaaaaagaaattatcgacgtcgcccagtttcacggtgccattcgcttaaagagccaggggagctttgaagaaatggaggagcggggggttaactacattgagttgcggatgctcgacctcgatccttggagcatggccggtattcggctaaacaccctctactttcttcggatcatggcttcttatttcatcatgactcccgggctagatgaagaggccgtttgtgaaacgattaccagggcgaatcagctcaacgaggtggtagcggtggaaaggccgaccgagccgaccaagtatgcaccaacggcgctggcctttttagaacgactagagctctttgccagtcagcttcagttggggccggagtacttagaggtcttagaggacatgaccgaccgggtcaaccgccctgacttaaccccgagtgggcagatggcgcggttcattaaagacggctcactgaccgaattcgggttacgccgggccttgcgttaccaaaagagcgccctgcaatccctgactacgtttaaggggtttgaaaacatgaccaccccgctgtcggcagaggacctaaagaaaaacctcttccggggcagttacgaaccaagtggcttaattcaatgataatagacgcctgtccggtgacccgggcgggcgtctttaactttgtcgccctaatttacgatctgtggtaagatgaatagtaatgatttgtgagtgaaaaaagagcccattagacaaccggtcgggtggggcatttacaattagatattgaacaaattaaaggagaagccatgagcaagattaagattattccttttggcggggtccgcgaaaacgggaagaacatgtacgccgtggaagtggacggccagatttttattctcgactgtgggttaaaatacccggaaaacgaactgatggggatcgacgtggtcattccggactggtcgtacctacaagaccacgctgaccaaattaagggggtctttttaacccacggtcacgccgacgccatcggggcactgccgtactttttagccgactttaaggtgccggtgtacgggtcccagttgacgatcgccctcgctaagttggcggttaaggaaaacaagcaggttaagaagtttaacgatttccacgtggttgacgaaactaagaccatcaaatttggtaacgttacgatcggctttttcaccacgacccacatcattccggatacattggggattgacgttcagacgccggaagggtcgatcgtttacaccggggactttaagtttgaccaaaccgccgttaagggttaccagaccaacttagctcggttagccgaagtcggaaccgaaggggtgctggccttgctcagtgattcagctggggcgggaattaccggcgcttcgaccagggaacgtgacatccgcgcctacatcaaagacacctttgaaaacaccaagggccggatcgtggttgcatcggtggcttccaacatcatgcggatccaacagattgttgacgcggcactggccaccgaccgcaaaatcgtgttgtccggcgaggacctcgagcagatcatcgagacggcggaggggctcaacttgctccaaattccggacgatacgttgatctcctttgaagaggccttggaccttgatgacgaccaagtggtgattttagtcaccggacggatgggcgaacccaccaagtccttgcaacagatcgccaatggtgacgacccagacatccagctgaccagcaccgacctggtttttgtgaccaccacgccgtcgtacgcgatcgaaacaatggtccaaaagaccaaggatatgctttaccgggcgggggccgaggttaagtttattgccgatgacttaaacccgtctggccaagccagtcaaaatgacgagcaactaatgctgaacttcatgaagccgaagttctttatcccgatccaaggggaataccggctgcttgaccggcacgccgaactggctgaagaagtcggcatcccggccgaaaacatcttcattaccgctaagggggacgttctctcctatgaagatggcaagttccacctgggggaccgggttgaagttggcaacacgatgattgacggaaccggggttggtgacatcggtaacatcgtcttacgcgaccggcgggtcctttccgaagacggaatcttcgtcgtggtggctacgattgaccgcaagaagaaaaagatcgtcgcccgtccgcagatcacatcacggggctttgtcttcgtgaagactaaccgtgagttgatgaaccaagcggccgacctggtcgaaaaggtggtccaagaagacctcgaccaaaaggaattcgattggggacacctgaagcaaaacgttcgcgacaaactgaaccgcttcttattcaaccaaaccaagcgtcacccggtgatcctgccggtgatcatggaaatcaaccagcaccccaagcgtaagaaccacactaaggcgaccaaggaagctaccaaggcaccggtggccaagaaaccggccaaaaagcaccacaattcccgtggtggtcgggggcggggcaagaagcgtccggcgagcgaagcaaagtaattaagtaaccaattaaacagatgggcttctagttgttcaattacgaacggtactaggagccccttctttatctgcaagaaggagggcactatgacaccggaacaaggagcacgatttaagcaggccacccaagcaatcgatcaggggcaatttggtgaggggattcggctgttgcaagagcttgatttagaggtcgatgactttgccgtcaaccgccagttagcccgggaactgtttgaagaccaacgctttgtcgaggcctaccaggtcgctgaacgccacttggccgattatgaccaatcccgtcaactagcggacttttacgtccagttggcccttaaaaaccaactgtttatccccgcccgccaattcatcagtttggcgacccacttaacggatgcggaggggcgcctggtcaaacgggccgaagaacaatatgaccgggtgggggcgcagaccttagcgagtcggcgccgccaatttatccacatgggggattgtagctttcgtgaacaacagcgccgctttagcgaggggcggatgctcccgctcagcgattacttggtgggggctaagttcttactgcgtgacccggatacccacccgttgatcaaatcatcactggtgcaggtcctccaacagctacggcttaacgaagagctcacggtgctctggcttgatgaaaaagagcaccctttaaacatcaaggagctcaagccgctgggtgaactgaccgtcgtcaaggagggggaacagttaattgccgcccgcttcgctgatcaagacccgctctcgtatcaaacctacctgcgagaattccacctgcaactggcctttttgtacccctttgtggagttagcaattgaagatcctgacgcttgggtgcaggccttggtggcgtattcggcaagcggaaatgaggagccaatcttgcgtgcacaccagtggcaggagcggattaacgcactagtgacaaggcttagttgaatttagctaaattcgtttacaaatgctaactgatctgataccattattaagaattcttcgccggaactgattttatcctttaaattggtttggcggagtagtacaattaatctaaaggtgtgtcagaacacccctggtggtctggcatgttacttgtaatttttcaggagggtttcattaatggcagaaaaagaacattatgaacgtactaagccccacgttaacatcggtactattggccacgttgaccacgggaagactactttaaccgcagctatcaccaaggtattggccgctaagggccttgccaaggcagaagactactctgatatcgatgctgctccagaagaaaaggaacgtggtatcactatcaacactgcccacgttgaatacgaaacggaaaagcgtcactacgctcacatcgacgctccagggcacgccgactacgttaagaacatgatcactggggccgctcaaatggacggtgcgatcttagttgttgccgcaactgatggtccgatgccacaaactcgtgaacacatccttctggctcgccaggtcggtgttgaatacatcgttgtcttccttaacaagactgaccttgttgacgatgacgaactggttgacttagttgaaatggaagttcgtgaccttctgtccgaatacgacttccctggcgatgatgttccggttgttcgtgggtccgctcttaaggccctcgaaggtgacccagaacaagaacaagttgttcttcaccttctggacgtcgttgacgaatacatcccaactccaaagcgtcctactgacaagccattcatgatgcctgtcgaagacgtcttcactatcactggtcgtggtactgttgcttctggtcgtatcgaccgtggtactgttaagatcggtgacgaagttgaaatcgttggtttgaaggaagacgttatcaagtccactgttaccggtgttgaaatgttccacaagacccttgatcttggggaagccggggacaacgtcggtgtccttttacgtggggtttctcacgaccaaatcgaacgtggtcaagttctggcagaaccaggctccatccaaacgcacaagcaattcaagggtgaagtctacgttatgaccaaggaagaagggggccgtcacacgccattcttctccaactaccgcccacaattctacttccacactactgacgttactggtaccattgaactcccagatggtgttgaaatggttatgcctggtgacaacgttaccttcactgttgaactgcaaaagccagttgcccttgaaaagggtctgaagttcaccatccgtgaaggtggtcacactgttggtgccggtgtggtatccgaagtgctcgactaatctcgggaattaacttctaaaagagtcgcgatttatcgcggctttttttattggcggactaccgggatttttaattgaaataccctcctttctagggtagaattaaaaagtatgtaggactctcgccaattgacgggaggctaaatagatatgttattggaggaaatgaaatgtcagtaaaatgggaacgcgatagcgacgctccaaaggggacgttaacgttcgatatcgacactgaaaccattcaaaaggggattgaccacgcctttacccgcacccaaaagcggatttcggttcctggcttccgtaagggccacgttccgcggacgatcttcaaccaaatgtacggggaagaatccctctaccaagatgctttaaacgacgtcttaccggatgcttacgaagccgccatcaaggaagcgggcatcgaaccggtcgaccaaccacaagttaacgttgaaagcatggaaaagggtcaaccttggaccttgacggccactgtggcggttaagccagaagtaaccttgggcgactacaaggggatggaagttcctgaacaagacacttccgtttccgacgccgacgttgacagcgaattagaaaacaagcgtcaacaacaagcagaactggtgcttaaggaagacgaagcagctgccgacggcgacaccgttgtcatcgactacgaaggctccgtagacggggaaaagtttgatggcggttccgctgataactactccttagttctgggttctggctcctttatcccgggctttgaagaccaattagttggccacaaggcgggcgaagacgtggacgttaacgttaccttcccagaagactaccacgctaaggacttagctggtaaggacgccctcttcaaggttaagatccacgaagttaaggaaaagcaacttccggaactggacgatgaatttgctaaggacgtcgacgaagacgttgaaaccctggccgaattaaaggacaaggttaaaaagcaactccaagaccaaaaggaagccgctgctaaggcagccatcgaagacgctgcgattgaagcagccgttgccaacgccgaaacggaagaaattccgcaagccatgttagacgatgacactaaccgtcaactccaacaatacttggccggcatgcaacaacaagggatcaacccacaaatgtacttccaaatcaccaacacgacggaagacgacctgcgcaagcaatttgctgacgacgcagctaagcgggtgaagaccaacttagtattggaagccgttgtaaaggatgctaacctaaacgctactgacgaagacgttcaaaacgaaatcgctgacctggcaaagcaatacgggatggacgaagaagccgtatccaaggctttgacccgcgacatgctggaacacgatatcgaaatcaagaaggccgttgacctgattgcggattccgcaaagcaaaccgccaaggccgctgacaaggactaatcatttaccgtgattaatctttacccaaagggggagtcgcaacagccatgcttgttgcgaccctcctttttaattggtagcttaattattttaaaacgcagcgtacgtctgttatgattatcctatcgattaccattaggaggtaagtaaatgtttgaagataccactggacaagatgtccactgttctttttgtgggaagtcccagtcggaagtgcaaaagatcgttgccggtcccggcgtgttcatctgtaatgaatgcgtggccctgtgccaagaaatcattgaccaggagctagccgaggaccgcacggaagcagaaacgttcaccgttccgaccccgcaagaaattttaaatcaattagatgactacgtaattggtcaacaagacgctaagaagaccctcgccgtagccgtatacaaccactacaagcgggttaacgccatggtgaccggtgataataacgataccgaattacaaaagtctaacatcgccgtgatcgggccgaccgggtccgggaagacctacttggcccaatcgctggcccggatcctaaacgtgccgttcgccattgccgacgccaccaccctgaccgaagcgggttacgtaggggaagacgttgaaaatatcatcttaaagctcctccaagctgccgattttgatatcgaccgggccgaaaaggggatcatctacatcgatgaaatcgataagatcgccaagaagagcgaaaatgtttcaatcacccgggacgtctccggggaaggggttcaacaggccctcttaaagattctggaaggcacgatcgccaacgttccgccgcagggtggtcgtaagcacccgcaacaagagttcattcaggtggacaccaagaacatcctcttcattgtcgggggagcctttgacgggattgaaacgatcgtcaaggaacgcttaggggataagacgatcgggtttgggaccgactccaaggaaattaacgacgtgactgaaaagaatatcttacaacacgtcattccagaagacctactgaagtttgggctgatccctgaatttatcgggcgcctcccagtcatgaccgccttagaaaagcttgatgaagccgacttagtgcggatcctgacggaaccaaagaacgccctggttaagcagtaccaagaactgatccgcttagacggggcggaactacacttcacggcgggggccctgcaagcaatggctaagatggcgattgaccggaacacgggtgcccgggggctgcgttcgatcattgaagacgtgatgcgcgacatcatgtttgacttaccaagccgccaggacgtggttaaggtggtcatcaataaggaatgcgtcaccaagcacaccgccccagaatacgtgttgcaaagcgaccaagcatcctaggcgaggaagacgaatgcaagtacatgatgttgaattaacgatctcggcggtcgaagaaaaccagtacccagccacggccctgccggagttagccctggtcggccgctccaacgttgggaagtcttcgttgaccaacgtgttgattaaccggaaaaactacgcccacacctcgggccaacctgggaagacccagaccctgaacttctatgaggttgaacacaagctttactttgtcgacgtgcccggttacggctacgccaaggtctccaagaagcagcgggaaaagtttggtaagatgatcgaaaactacctgaccacccgcgaacaactgcgcggagtcgtccaattagttgacgggcgccacgccccgacggaagacgaccggatgatgtttcagtggttagcctactaccacatcccgaccctggtggtggccaccaaggttgacaaggtcaagcccaacgcccataaccggatcgtcaaggtcgtcaaagagggcctgggcgccgcaaaggatcaggacttaatcctcttttcggcgacaactaaaaagggcgccgagtcggtttggcagtggattgaagaacggacgggagtaagtgactaatggagtttaatgactatcaaaaagcggccaaaagaacccgctacggcaacgaacaggtactgactaactgtgccctgggcctagcgggcgaggccggtcaggtggttgacctggtcaaaaattacacctttaagggtcaccccttggataaggaccagttgacccacgagttaggtgatgtcttatggtacctgtcccaaattgccgaatgggccgatattcccttcgatcaggtggccaaggacaatattgaaaccttgaaccgccgttacccaaacggctttaatagacaggcctagggtgggaagccctactttgtgtacggtaccttaaaaatgatgaaaggggctgggagatgcgttctcccagcccctttttcgattgaggccgggaaaaaactccgttttccccggcctcttgctgtattcccgaatgttagacagaaaacgtggtcaataaccgcaggcctagtgtctaagcaggccgaagaacggtgcgtaccgcaccaaccgttcgtcctagcttagtcatacggcctgccgagtaggttatttcccacccacttttacttggcggaaccttcttttttagcggcgtcttctttggcgtcctttggttggtcgtccggttttttaaccggcttgagcgggtcgctagcgaacttattgaataagtcgtccagcttatcgctgcggcgagtgacaagtcccattaggcatcctcctttgtggtgctaaattagggctattttagcacagatgccggatgaaaaaaagcaaagcggcgccgctttgttatgcataaatcgggaaaaacggggatttatatgcgatttacttgcataataattcgttagttagtataatgggttcattatcaacagagacgagggagcaacgatggaagataaaacaatgattgaaattaaggacctcaagaagtccttcggtaaaaacatcatcttagacggggttaacgaagaggtcaaaaagggccaggtgatctgcgtgattgggccgtccggggccgggaagagtaccttcttacggtgtttgaacctgctagaagaaccgagtgcgggcgccgtgttatttgaggggcaaaacctggttgagatgggggccaaggaagttcaaaccgtccgcgaaaagatggggatggttttccaaggcttcaacctctttcctaacatgaccgtgttagacaacgtaaccctcgccccaattaaggttaaggggatggacaaggaaaaagcacaaaagctgggacaccaactgttaagcgaagtggacatggacgataaggctgatgcctacccactgtccttatccggggggcaaaagcagcgggtggccatcgcccgggcgctggcgatgaacccggaagtgatgctcttcgatgaaccaaccagcgccctggacccggaaatggtgggggaagtgctcaaagtaatgcaagagctagctaacaacgggatgacgatggtcgtggtgacccacgaaatgggcttcgccaagaacgtggccgatgaaatctggttcatggccgacgggaacatccaagaggtggccagcccccaagaattctttaccaaccccaagactgagcgggcccaggacttcttggaaaagatattgaatgcgtaattaaaggaagtgcgggccaaccattaagcaggccgtgggctaaggaaaggttgggggttgatgcggcacgcatcgttttccggccagacttagccactaagctaggacaggggtaaattgcacgttgctttaaattaacatccggtcgcttcgcaaagtacttgcgaaggaccggatgtttatttgcagggagcggtagcacggccttttctttgcccccgcccccaaaaagccgtaaaatagatttatcaaacacctgtttaaagggggaacgagattggcaagtgagtacttagaacacaagctggccctcttgccggaccagccgggctgctacttaatgaaaaacgccaacgcccagatcatttacgtcggcaaggccaaaaacttaaagaaccgggtgcggtcctacttcaagtctagtcacacggggaaggtggcggcgatggtcgaagaagtggccgacttcgaaacgatcgtcacctcctccaataaggaatcctttttgttggagatcaccctgattcaaaaacaccaaccctactacaacattaagcttaagcgggggacggggtatccctacatcaaaatcaccaacgagcgcgacccgatcattaagattaccggccaagtcaaaaaagacggcgcctactactttggcccctaccccaacgtctacgcggccgaagaaacggttcacttcattcaaaaggtctttcccttacgccggtgccatggctaccaggggcggccgtgcctgtattaccacctcggccagtgcctggggtgttgctttaaggaagtaccggaagaagaatacgccgttcaaactaagcggattaagtcctttttaaatggcaataccgcccaggtgaaaaagcagttgaccgcccggatggagcgggctgccgggcagctcgaatttgaacgggcggccgagattcgcgaccagctccactacattgaagtaacggtcgaaaaacaaaagatcatttcaaacgataagaccccccgcgacctctttaacttttacttggacaagggctggctaagtatccaggtcttcttcattcgccaggcccggttaatgaagcgtgaaaaacggctcttcccggtggtcgatacggccgaagaggaaatgacttcctttatcctccagttctacaaccggcgcaacaagttgttgccaaaggaaatcctcttgccggagggattaccgaaccaagaaatcgaggagatcttaggggtgccggtgcggaccccccagcgcggggagaaacgcgacctgctggacatggctaaggaaaacgccatcctgtctttaaacgaaaagttccgcctgctggaaatggaccgccagaaaacgaccggggcgatgaaagagatcaccgacgaactgggcctgccaaccggccacgtgatcgaagccttcgaccactcccacattcagggggccgatccggtctcggcgatggtggtctttgtcaacggcgaaccggctaaaaagctgtaccgcaagtacaagctaaccaccgtcgttgaccacgccgacgaagccgcttcgacgcacgaagtgatctttcggcgctactcccggctcctaaaggaagaaaagccgatgccggacatgatcatgatggacgggggaccgattcaaatggaggcggccaaggacgtcttggaaaaccaactcggcttaaacattccggtgatcgggatggtcaaaaacgataagcaccagactgccgacctcttgtacggcgacgatgcccaccacgtcaatttggacccgcgtagccagggcttttacctggtgcaacggattcaagacgaggtgcaccgcttcgccattacctaccaccgcaaggttcacaccaagcactccctgtcgtcgcggctcgatgagattcacggggtcggtccccggacccggaacaagctcttgaaggcctttggttcgattaataagattgccgtcgccccggtcgaagaaatcagggcgctcgggattaaccaaacaaccgcccagttaatcaaggtctctttgcaggggcaagccgaggtcaagaaggggtccagtcatgactagctttgacctgacggggcttttcccatatactagagaatgattgaattaagaacggagaagatagatgccaacctttgtggatcaaattaaaattgaagtacacgccggacacggcggtaacggaatggtggccttccgccgggaaaagtacgttcccaacggtggtccggccggcggtgacggcggtcggggtggctcgatcatcttaaaggttgatgaaggcctgcggaccctgatggattttcgctaccaccggatttttaaggccaagaacggtcaaaacgggatgagtaagcaaatgaccggggcggccgccgatgacacggtgatcgccgttccccaggggaccacggtccgcgatcttgacaccggtcagattgtcggcgacctggttgaacaaggccaagaactggttgtcgccaaggggggccgcggtggccggggcaacattcactttgcctcgccgaagaacccggccccggaaatcgccgaaaacggtgaaccgggcgaagaccactacctggagctcgaactgaagatgctggccgacgtcggtttaatcggtttcccgtcggtcggcaagtcgaccctgctttcggtggtgaccggcgccaagccaaagatcgccgcttacgagtttaccaccctagtgccgaacctcgggatggtaatgctaccggacgggcgcgacttcgccatggccgacatgccgggattgattaacggcgcctccaagggggtcgggctggggctccagttcctgcgccacatcgaacggacccgggtgctcttacacctggtggacctggggaatcaggacgccgaattggcgctcgagaagttccacgatattaacaaggaactggcttcttacgacccggaactcctcaagcggccgcaaattgtggtagccaccaagatggacctaccggaagctcaggagcacttggacgagtttaagaagctactggaagcggacgacaccctcccggagacgccgcaagtctttgcgatttcggcggtaactcacgccggggttcaggaactgatgcaaacgacggccaacctgattgaagaaacgccggcctttgacgccaacgcccacgatgaacaagaagccgtcacttacaaggcgccgcaagaagcggaaccagacttcacgattagccgggatgacgacgggacttgggtcctgagcggggccaagttggaacggctcttcgtgatgacgaacttggatcacgaagacagtcagctgcgctttgcccgtcaactgcgccacatgggggtcgatgacgccctacgcgaggccggcatccaagacggcgatttggtacggatcgaggactttgtctttgaattcgtccaataatttgatgattagaaagatggtttagaatgcagattgaatttttaggaactggggcggggtcgccaagtaagcaacggaacgtttcaagcctggccctgcgcctgttagaggaacgcaacgccatttggctctttgactgcggggaggcgacccaacaccagatcctgcacaccaccattcgcccccgcaaggtggaaaagattttcatcacccacctgcacggcgatcacatctttggtttgcccggcttcttgtcgtcgcgctcctttcagggcggcgacgaaccgctaaccatttacggacccaaggggattaaagactttgtgcaaaccgccctcaaggtgtcggaatcgcgcctgtcttacccgctcaagttcgtggagctgactggcgatggcgaggtctttaaggaccaaaccttcaccgtgaccgcccggcggctggaccacaagattgccagctttggctaccgggtggaagaggcggcccaccctggtgaactgatggttgaaaaggtacgccaagctgggattccgtcggggccactgtacggccaactcaagcgcggtgaggtggtgaccctgccagacggccgcacggtcgatggccacgacttcatcggggcgccgcaaccgggccggatcgtcgctattttaggcgatacccgggtgaccgataacgccgttaagttagctaagggcgccgacgtcctagttcacgaggcgacctttgccaaaaacgagcaacgcttagcccacaactactaccactcaaccagcgcccaggcggccacggttgccaaaaaggcgggtgcccagcgcttattgctcaaccacatttcggcgcgttacgtcggcaggtacgccaatgagctggcctaccaagtgcgggacatttttgagcaaacccgggtggtgaatgatttagacgtcatcgagattccttttaaggaaaggtaaggaagcgagggtgaaggaccatgttaatgattaagcgactgaagcaactgcgttttttgcgtaacaaggtggttttgatcaccgggggttcggaggggatcggcaaggcgctggccctagaagccgcccggcgcggggccgtcgtggtggtggccgcccgcaaccaagaaaagcttcaagaggtagcggaccgctgcctgatcttagcggggcgcccgtcctttgcctttaaaatggatgtgaccgatcccgaccaggtggatgaggtccttgaccagattcgccaccaggtcggggaaattgacgttttgatcaatgccgccggcctcgggatgatggacgccgtggttgaccaaagctacgcgaccatgcacaagatggtgacggtcaacttcttggccgccatgtacctgagccggtgcgtggccaaacagatgatgaatcaagggtacggcgccattattaacgtcgcttcgttgggcggcaagatcccgacccctaactcggcggtttactcggccaccaaggcgggggtgatccagttctccaacatcttgcggatggaagttgccgactacggggtccaggtcctaaccgttaatccgggaccggtcgccaccgactttttcaagaaggccgacccgagcggggaatacatggcccacctaccgcagtggtttgttatcgcaccggacgccttagcccgccaggtctgggacaacgtgggttacgaaacccgcgaaattaacgtaccgggctacacgactgggctcgcctgggcctaccagatcatcccgggcctcggggactgggcgatcaagaagttcttcaacttccaacaaaataagcataacctctaaagtaaatgactccagcagttcgtaaccgggtgctggggtcttaatactgttaagacttagaaaggaacgggcatgattgacagcaagtacgcctggcaagggcaagcaaacggcgataaagaaacgatccaggtggtggccgatgcgacggggctaccggcggagttagcggcccttttagtcaaccaggggattaaaagcgctgacgccgcccaacggtggctcaacccgcaagcagaagacctccacacccccgacgcgttgcacgacgtcgaccgggccgttgagcggatcatggcggcggtcgaagcgggcgaaaagatcacggtctacggcgattacgacgccgacgggatcaccgccactactttgatgtacgaggcactggaaacgctgggggcgcaagttgattattacgtgcccgatcgtttcactgatggttacgggcccaatcaagcggtctaccagcggctgattgaggggggcacccagctaatcgtcaccgttgacaacggggtggccgggctggcggcgattgagtatgccaaggagcagggggttgacgtggtcattaccgaccaccacgccctgcccgaacaactcccgccggccgtggcgattgtccacccccagtacccgggtagcgagtatccctttgccgatctgtccggggtcggggtcgcctttgaagtggcctgggccctgctgggtgagttcccggtggaaatgctggacctggtggcgatcggggagttggccgacctggtttccctggccggtgaaaatcacgccctagtggcactggggttgcagcagctccgccaggggagccggccgggcttgcacgccctgctgaagttagccggggtcaaggaggcgaccctgaccgggaccgacgtgggcttccaactagcgccgcgcttaaacgccctcggccggattgaacaggccggcccgggggtggtcctcttgtccacctttgacgaagaggaggccgaacggttagctaaagaagtcgatcaaaccaacgaggagcgtaagcaactggtggagcagatcactaaagaagccctcgcaatggcggctaaccaacaggtgcccgccctggtcttggtgggccacggctggcaccagggggtgttagggatcgtggcggcccacgtggttcaagcaaccggtaagccaaccatcgtcgcttccgccaacgagggtgagacgatcgcgaagggctccggccgctcagtggatggcctcgatttgttcgccgccctggatcagcaccgcgacttgatgacggccttcgggggtcacgcaatggcctgcgggatgtcctttgaattaactgcggcagcgcccctacaagcggccttaaacgaagaggtcacggcgcagggctttaaccagcagcaaaaaccgccgttaaaaattaccctgaccttggcaccagaccggctcacccaggacctgtacacgcaaatccagcggttggcaccctttggcccgggcaacgaggagccccaaatcgaactcgacgtcaagggaccggtggcgacccaggtgatgggcaaggacaagtcccaccttaaactaaaggtcggtcaaccgccgttagacgtggtcgcctttggcaaggctagcctagcaccggccctggccgaggcggaagaagtcaaactggtcggcaccctcagcttaaacgagtggcggggcaagaccagctgccagctgatgctaaccgacgtggcggccaccggagtcaccgtgctcgaccaacggacggcccggctgttgccgccgatgtttgaaccggctgcggtttacctggccttcgatgagcggctgcgcaataacattaatggccacgctaacgggccggtggttggccctaaggacctcaccgccgacctggtagccaaccaggaactggtagtggttgattgcccgccgatcattagccagctgaccacaagcttggctaagtgcgcggcggctagttcgatccgactcctgtgctacttcaaccaggcccccctgaccgggatgccagcctaccaggcctttgccaacctgtaccgcctgctaggtcaaaaccccaacataaacatcaaccagcaggtcaacccaattagtaactacctgcgcttgccagcggatcagttaattttcatgataaatgtgttttttgaggctggatttgttacaataaaagatggtgttttaaatctcgtcccgcaggatcagcggcgggaccttaaagaaacaacgagttatcgtcgccgccaggcgcaattagaagttgaacgggccctggtccattcgtctcaccccgatctagtggcgtgggtcaagcggctggttggcgcgcgctaaaggagaaatttttatggctattaatctttacgattacgtcgctagcattccggattaccccgaaaaagggatcgttttccgcgacatcttgccgctgatggcaaacggggaggccttcaagcaggccaccgatgaaattgccaactacgctcgcgacaagcacgttgacatggtggtcggtccagaggcccggggcttcatcgttggttgcccggttgcttacgaactcggggtcggctttgccccggcccgtaagaaggggaaactgccccggccggcagtctcttcgacttacgacctggaatacgggtcggcaaccctgcaaatggaaaatgattctatcaagccgggccaacgggtgctagtcgttgatgacctcttggctaccgggggcacgatttcggccaccatcgacatggttgaacaaatgggcgggatcgtggtcggttgtgccttcttgatcgacttaaaggacctaaacggccgcgaaaagctgaagggttatgacgttaagaccctgatggaattcgagggagaatagttgagtgcgatccatccatcaggcagaccgtgggctaaggataggacgggggttgatgcggtacgcatcgttctccggccagacttagccactaggtctgcggctgggagcacgttatcagtgctgccgttgcgacccaaccattggctaggcacgcatcccatgtaaaacttaaccagcgccgaggagaaaagtcgtttttccctcggcgctttttgcattcaagtaattgatcaccaaaactgatcaattcgatcgccaaccggaattggcaagtgaccgtccaacagcgataatgggggaaagtcattttgattaaggaggagcgccatgacgagaagcgatgaagaagcggtggtggaaatttaccgggccgaaaaccgggcgatggttgaacgcgaccaggccaccctcgaacggatcctggcggaaacgatgaccttgacccacatgaccggttacgtccagccccgccaggagtggatcgcccagataatggacggaaaaatgaagtattattcttcaaccgaggagcgagactttgacgtggtggttgaaggggaccaggccagcctagtgggccaaaaccgggtcaaagcaagtgtttggggcggcggggttagtacctggcccctgcaaatgcgagtcaacttgaaacgtcaggctgggcgttgtcagattgtcagccaggtggccagtacttactaatctgaaccggtaatgctcagtccgaaaccataaaaaagcaccgctcacgaatgggcggtgcttttttgctaggctattattaaccaaccttaactggggtttcaggttcttcacccttaaccagggccaggttgttgtcgaaggcctttaataccatgttgcgaactgcgtgcgtggtgtagaaggcggtgtgaggcgttaccaagacgttgtcgcggtggatcaagtcgttaaggcgggcgtcagggaattccttaccttgccagtcttcgttgaagatccccacttcgtcttcgtaagtatccatgacaaaaccgaacagcttgccggagtccagggcacggataacggcgtcggtgtcaaccaacggaccacgagaaacgttaaccagtacggcgtcgtccttcatcttggcgatcgtttcgtcattgatcatgtggatcgtgctttccagggccggtacgtggagggaaataacgtcagcttgggcgtagatttcgtccaaggaaacgtagtagcccttcttttccagttccggatccttgaagacgtcgtaggcgatcaccttagcgccgaagccttccatgatttgcatgaagacttgaccgatgtgacccgtaccaacaaccccaaccacttggtcacgaacttcgcggccgatggttggtgcccaacggaggtccccgttttcgatcttttcgtctaacttcttggattgacgaaggatgcgggccgtttggatagcggcgtgttcagcgatggcgttcggagagtaaaccggaacgttggtgatttcaaagcccagttccttagccttggccatgtcgatgttgtcgatccccacgttacgcaaggacatcttagtaacgccctggtcggcgagggcttggagcgtttcagcggtgtagtcgagttgttggtaaacaactaccccatcagcaccagctgcttgagcggccgtttccggcgtcaacagtttggccgtgtagtcgaccgtcacgtcagcgtggttctttgcccattcgttcaagtaaggttcttcgtccttgcggattccgtatgcgtaaatttttgccatgaatatacctcctgtaacatgtacgtcagcttggtaacgttgccaattactattatagcgaatcttttcattatttaaagtaaaactgcatacaatttacctaacaaatcgattagactaattagtgttttttaattattttattgacgaacgacgaaaacgcccttatactaacatcaagaattagatagagattaaaaagctgtgacggaactactgtcggaacttcgtgaaaaagagaactagcggctggtggaagctaggtacgaaacccgaataagtgatcattcccgagctactggctgaacaaagtaagctaagttggttaccacccattatcctggtcgcgaatgaaagtttgtgctaagtggctcacttttgagcaagtaggatggtaccacgtgaaagcgctcctactccctaatgacggggaggaggggcgtttttgatctcgtcaattccaatacatagtgcgctaccagagttaaaggaggaagaattatgactgaactaaaccaacgccaagcagaatttgcccaggctctctaccaaagttacatgaccaacgttgccctcaacgaagacgattggcagggcgtggtccaagactttgagaccgcctacgccgtccaggaacgggtgatgacactcaagggtcaaccgaccgccggctataaagtttctctgaccagcgaagagacccagaagatgtttgacaccgatgcccccctctttggtcaacaggtcgccgagcgtttcttaaaaggcccggctggggtcaacctcgaccacctcaatgaaccactggtcgaagtcgaactcgccttccgggccaaggaaaccctccagccgactgattcactagaggaccttttgcataagaccaccgtagcgggtgccgttgaagtgcccgacgcccgcttcgttgactggttcccgagcctgggtaagtacaacgtcttgtcagactgcgccgtggggggattagtggtttatggcgaggagcgtgacagcgaccaggccttttcctcggttgaagacgccgccaccgttcacgtcgacctctaccaaaacgggcaacaggtcggcgaaggggactccagcgaagtgttggggaacccgctcaagtccttgcagtggttggttaagaagcttgatgaacaaggcaagcagttcgcccgcgggcaggtggtatcttccgggaccttcctcttgccgccacacttgacggccgggcgctgggaggcccgcttcaaccacgacttcggcaacgttttggtcttggcacggccgacgctggcggaattttagaaagtgagtgcgacccaacctcctcgacgggccgttggactaagctaggacgggggttggtgcggaacgcaacgttctccggccgtacttaggcactaggcccgtggttgggagcacgatattggtgagtgcgacccagccaatcaagtaggccgtgggctaaggacaagacacgggttagcgcgtcagcggtgttctccggccgtacttaggcactaggccgacagtgtaaccataagagagaccgttcttaaggggcggtctttttttgagtaaatttctggcggaaacccttgacttggagttaactcaaagtagtaaattaaggtcatcaggaggaaaatgacatggcgaatttaacgattacccaggtggccagcaagtacggcctgacgccgctatcatccccagggggtccaagactggatcgagatgatcgtttgcctgcgccactcgggggtgccggtcgacgttttgcaaacttacgctaagctactagagcagggcgatgcgacgttaaccaaacgccgggagctgttggctgaccaactcgaagttttgttaaacaagcgccacaacctggaccgctcaatcaatcgtttggagcacaagatcgctttgtacgatagcggtgagattcgggccaggaagagttactttgaagaataccaaattttagatgaccaaaaggagacactttaattatgaaaacaaccgtctttttattccaccccaacttcgccaactcccgcgtcaacaaggccttagccgccggtttaccgggcgacatcgaggtccgcaacatgtacgctttgtacccggactttcaaattgacgtcgccaaggaacaagccgtgatggaggaaagcgaccggatcgtcttgcaaacgccgatgtactggtactccgggacgccgctgttaaagaagtgggaagacgacgtgctgacttacggctgggcctacgggagcgacggtaacgccctgcacggcaaggaactactggtggcgatcacgccgggggccgacaactacggcgccggcaagttcgtcccgtacacggtttacgaattgttacggccgttccaagcgatgagcaacctgatcgggactaagtttgttaccccgtttgtgacgaccggcgctagctcgatcagcgacgaggacttagccaagcgggtaaaagagtacgccaactacctgagccaagacgagttaaaggtgctcggcgcctttgaatagggggattgaaatgtatttaattgacattcgtttgaagggtgatcaggtcgcggaagaccaactgaccgcccactgccagtggtttagccgccactttgaagcgggcgactttttgatcgtgggtccgtccaagagtcgtgcccagtccgggttgattttggcccggcagatggcccgcaaagacctggaccaaattattaccgaggatgccttttacccggccggggcggattacttagtcaacgaatttgaagccaagctggtagccgaccagattaagggggatgcgtaatggcactaacagtcaacctttattacacggggaaaaacggcagcgcccagcaatttgctaaggaaatgatcgaccagggggtggtggccgccattaaggccgagccgggcaaccttaagtacgattatttcattccctacgacgacccggagaccctgctgttgatcgatagctgggccgaccaagcctccctggatgcccaccatgcttcgccaatgatgaagcagttggccgagttgcgggagaagtacgatttgcacatgcgtgttgaacgttacgtcagcgatgaccgcggcgatgacgtcgacgaacagtttattcgaaagtaagagagtggcaaccaacctggtcccaaattaaaagaatacaataacccgcgctaatcccgattgccataaaaatcaaaacaaaaagcgtcttgaaaaatccaaaagtgatgataaggaccgctaagagcaatcctataattccaccaattagtggccaaaaatagtctttaatgagttcggtcacgttatcacctcctagacaactcgagattgatgcacattagcgtccgactcattgaaatcaacgagtcggatttttatttttttctgttcagaaattccaagacaaatacgcaaatctttttttaattgattgagaaaatttgcagtctgtttcttggcattgactgaatttagtagatcacccgatattttaagtgtgatcctttttcgtgataacttagctgataccttggggttaccaataaagggttcatgttgaagtgctgaaagagcaaaatgctcaatagctttcttactgatggtaacttgaccatcagacttttgatgaagatataataactgtgaccgtggccaaaaaagtgtgataatcaataaaacaattaacaccgccgccagaattatcccactccaaaaaaggtatatcggttcgtactgatccaaccaatcaaactttaattgcatgggtgtgctagtgccaatggccgttgaccaatttttaaagacaagaactatggacaaaggaaatgcaaggataataacaactactattaaagccttaaatataactcgcaaatcatcaccacctttaccatcattgtagcaggacagtagtgataatggaattatatgcacttatgagaaaccaattaaaatttttatttgactaaaccaatctggccactagggtataccttattggctttacttggctgtatgaactgatgccacctaaaatagttcagtaggattatccaaatatgttagcaattcctctatcaatgatattggatgtaagctgattcctgagacaacttttaagagagggtataatgaataaatcatctctcaaaaggaaggaatttttacatgccaactcgttacgacaaagaattcaaacaaaacattatcaacctatataatcaaggcgaatcagctgcccaactggccagagaatatggcattggctattcaacagttcataagtggatccagggtcaggccaaaacttaatccggtaaatcgccagacgaaatcaaagcgatggaaaagcgactggcttcgctgtctgaggagaacgaaatcctaaaaaaatccctgggcttccttgcgcagaagtaaccaatatctttgattacattcaccaagaaagccatcaccaccaggtaaccaagatgtgccgaatcctcggtgtttccagagctcagtattatcgttatcgatcccccaaaccttcaaaacgccgggccgaagatgcgggcttgaaacaacggattctgcggatctttgcggaatttaagcagcgatacggtgttatgaagatccaccatgaattgaatctggaacttcaaccactgcagcttcggcgcagtccacgacggatttaccggctcatgaaggaactggatatccactccgttaccgtcaataagtggaaagcggctttggcttacaaaaccaaggttgaacagcgtcccaacttgcttaagcaggatttctcgaccactggtttaaatcaaaaatggaccgctgatatgacctatattcaaacgaagcgtaatggctggtgttacttatcaaccatcatggacctgcactcacgacggattatcggctattcgttctcaaaaaagatggatactgatttagtcttaaagacccttgaaagcgcggttaaaaatcgaaccattactggggacctgattatccatacggatttaggatcacagtataccagcgatgattataatcaacggttaacagaactacatatccgccactcatacagccgtaagggttgtccgtatgataatgcgccaatggaatcctttcacgcttccctcaaaaaggaatgtgtttatccagtgccggtctttgaagattatgaaactgccgctgctgtcctttttgaatatgtgcatgctttctacaataggaagagaattcatagttcactgggctaccagacccccttacaagttgaaatcgcaacacttacgagccaaatggccgcctgatttaatgctttccgtggttcaaataagttattaatcacgattaatgatttatttaagctgtggaaggtaaacgcggttctgaatgtctcttaaaacctgtctcaaatattgacttcaatccaccacaaccacaaacgtttgaagacttagaacagctggtgacagaatgtatcgattactttacgcattcctttatttcaggcaaaagaaatgaccttaccgcagcagaataccgcttcggcaaggccaactagtttttattatttaatgtgtcaacttgacagggcacagtaccctgagctaagccacccactcaaatacactcctcaaaaaaaggcgacccaggaaaccgaatggttttcctgggtcgcctttatttttacgctagcaaacgtgggagctagccgttcgccctagcctcgtcatccgagctacaccaggggttggtgcccacttccctttattccaagaagtcctttaactgcttggaacgggatgggtggcgcaacttgcgcagggccttagcttcgatttgccggatccgttcccgggtcacgccaaagacgcgtcccacttcttccagggtccgcgtccggccgtcgtccaaaccaaagcgcaggcgtaagacgttttcttcccggtcggtcagagtgtccagcacgttttcgagctgctttttcatcatctcgtaagcggcgtggtcggccggactggtggcgtcgtggtcttcgataaagtcccctaagtgggagtcatcttcttcaccgatcggcgtttccaaggagaccggttcctgggagatcttcaggatgtcacgcaccttttgggtgtccatgtccatttcggccccgatttcttccggcagcggttcccggccgaggtcttggaggagttggcgttggatccggattaacttgttgattgtttcaaccatgtggaccggaatccggatcgtccgggcctggtcggcaatcgcccgggtgatcgcctggcgaatccaccaggtggcgtaagtggagaacttgaagcccttacggtagtcgaacttttcgaccgccttcatcagccccatgttcccctcttggattaggtctaagaactgcattccccgacccacgtaacgcttagcaatcgaaaccaccagccgcaagttggcttcggccagttcttgcttagcggtttcgtcacccttttcgatccgcagggccaacgccacttcttcgtcggccgtcagcaggttgacccggccgatttccttgaggtacatccgcaccggatcgttgatcttaatgctagacggagcggtggtatcctttaaggccttggaggacagcttttcggttgccttgagtgcccgcgggtccgggtcaccgttttcgtcaaccacggaaaccccggcgtcttccacgttttgcaacagggcgtccatcccgtcggcgtttaagccaaacggttcggcaatcttttcggttaattcatcgtactggatgttttttgccttcttgtaattgcgaatcaaagccccgacggccttgtcgtattcggcttggttgaaatcttctaagttcgaaattacccggttcttcttactgctctttgccattaattaacatcctccgttttcatcttctgttcctgtcgccgcaagtcaatcaactcgatcgtaagcttggtgatcaattgttgatcgtttaaggcggcagcctcctgaagggcggccgttttctctcttatttgttgttcaatcggggcgacgtcgacgagcacggcaaggcaatcgtcgacggtctcatccaccgccgcttgtggcaccacccgttgctcgatctggccaacgatcgtcctgagcttagcgtcggtcagctcccccattaactgggcgacgtccacctcgtcggccccggtcctttgcaactgctccttggcggccgcgtcaaggagctggtaagggcgatcgacaaagtggaagttttcaatcgcccccacgtggctgcggacggcgggattatgaaacatctcccgcaggagccgttgctgagccaattcgaccttccccaacagcggtggcgcctgggtactcggcgcggtagttgtggtggggggcgtggattgataacgccgcgtccctgcttgccgcggctgacgaggggagttctccgggtaagccgggcgtggcgccgcggtcgccgctagttcctgcacctgcccggtcaaagtggcgggatttaagtggtaatccttcgccagctgttgaatgtagaggtcccgttccaccggatcagtgaccttagcaacctcccgcaaggcggcttcaacgtagtgcaagagctcactttggttggctaggttaagcccctgctttaaaaagtgaagccgaaaggcggtcggcgtctcctcggcgtgggcgaggtactcttgaaacttggcttgaccattagcttggacgtactcatccgggtccataccggccggtaactggaccacgcgcagggttaaccggctggccgccagcatcgtcagcgcccggttgatggcgttttgcccggcggcatccccgtcgtagcaaatcgtcagcttatcggtggtgcgggcaatcacggccacctgctcgtcggtaaaggaagtccccatcgaggcaatccccgaccggacccccgccccaaaggccgagatcacgtccatgaagccttcgaagagggttaggtgtccctcctttctggccgcctttttggcttggtccaggttaaagagggtccgccgtttattaaagatcggcgtctccgggctgtttaagtacttaggggcgttttcggtcgcctttttagtcaataagcgcccggaaaaggcgattggttgcccgttagcgtttttgattgggtaaatcacccggtcaaagaaacggtcgtgcaactgcccggtttggtcctcggtaaataagcccgaggcccgcatgagctggtaatcgatccccttttgggtgaagtacttgaccaagaggtcctcttccccccgggcgggggcaaaaccgaggttaaactggccgattaactcccggctcatcccccgcttggttaggtaattgagggccggctgtcccgccacagtgttaaccaaaacgtggtggtaaaggcgactggcctcttcgtgtaagcggtaaagcggggtgttgggagaggcgctttccccgctcgggccgttactttcccttggcaagtcaacccccgccgtcgtggctacctgttcgacggcctccatgaaggagaggtcgtgggcctgctccaagtagctaaagacgtccccgctgcggtgacaggagaaacaataaaaatactgtttttcttcgttgaccgaaaaagacggggtggcatcctcgtgaaagggacagtgccccatcaggtttttcccctgctttttgagctggatgtcttggctaatgacgtcggcaatgtccacttggttgcgtagctgatcgatcgtttcccttgggatttggggcatccaccattccccctctcgctagcgatagttacgaaaggtcgccttcccgttggaatgcgacctttcgaattaaacgacattaaattgtttggggcccacttttactagttatcataataccataattttagtggtgggccaactgtattgcctacttaacaatcaattggtctaagttcccaaaggccgccgtttggtccgccaagatcgtcaataaggagaggcggttgttcttaaccgcttcgtccttgtccatgatcatgttctcttcaaagtagagcgagatgactggttccaattcgagcagggcgctgaactgttgatccaaactccggccttccttggcatcaatcagggcttgaaccgcttgatctaactggccttccgatgggttttcaaagaggcttgggtccaccttgacgtcgtcttcagacaggttccccttggcggccaggcggatcacccgggtcagggcttccacttggtcctttaagtccgcgtcgtccttgtgggcatctaagacgtgagcggcttccacgatggcggccgggtcggtcacgtgggtgtcggtgacggcgtcgacaatgtcgtggcgcaagtggtctaagctaaagagctgcttgagccggtcgatgaagaagtcggtcacggcatccgcattcttagcgtaatcaaggcccagggctggcgttgcttgttccaccgcttgcttggcactcgcttggaaatcaagcaagttcaagtgccacttacggtccgccagcatccgcacgattccgtaggcctgacggcgcagggcgtacgggtcgttggaaccggacgggatcatgtctacggcaaagaaggagtaaattgagtccagcttgtcggcaatcgccaagaccgccccgaccgtcgtttgtggcagggccccgtcggcggaaattggcatgtagtgttcgcgcacggcggcggcgacggcctcgttttcgccaaagcgcttagcgtagatttcccccatgatcccttgcaattcggcaaattcgccgaccatttgggtggtcaggtcaaacttgtaaatcgaagcggcccgggcgagatcggccagttcttggtcgcttaagcctagttgttgccctaagaggttagccagggccttggtgcgggccatcttgtcgtacatcgacgaaatttggtcgtggaaagaaacgttcttcaagcggtcgacgtactggtcgatcgtcatcttttggtcttcgtcaaagaagaacttggcgtcttctagccgtggtaccaacacccgttcgttccccttaatgacgttatctaagtggacggcgttcccattacggaccgaaatgaaggccggttgcagcttcccgtcgtggtcgcgtacacagaagaagcgttggttatccttcattgacgtgatcagaaccggttccggtaattccaggtacttttggtcaaaggtcccggcaaaggcggtcggccattccaccaggttgttaacttcttctaagagttcttcgtcccagtcgatcacccagttgtgttggtcgacaattgcttggatctggtccttgatcgtcgccttgcgttcggccgcgtcgacaatcacgaagtcgtcctttaaggcggccacgtaatcggtggcggacttgatttcaacgtcgtggcccaagaaacggtgcccacgggttaaacggcccgccgtgacgttcagaatgtcaaagggtaccacttggtcatcgagcaaggaaaccagccagtgaattgggcggataaagttgagcttaaaactcccccaccgcatcaaggttgggaagttcatcgccgtgattacgtcgtttaaaccggccaagacttcggcgactggcttgccttggatgtgcttttcgacgtaaacgtattcgacgcccttaacttctttaaattcgatgtcgtcaaccgtggccccctgaccgcgggtaaaaccaattgccgccttggtccagttcccatcggcgtcttgggcgatctttttggctggtcccttcaccgattcatcgacgtcgggttgcttgtcggccaaaccagaaatcaacagggctaaccgccgcggcgttgagtaggcttgaatgtcttcaaagtcgatccgttcttctgttaagtagttggccacccgggtctttaattgttggatgcttggggtaaccacgtgggccggcatttcttccaggccgacttctagtaggtatgaacgtgccattagttttctcccttctctgcccgcttagcgttgcgcttggccagttcttcggcttgcttggtgtacttagccacgacggcttggcgttcctgttcgtcgtgaatcagcgggaagcctaacttacgccgttcttcgacgaaggccttggcgaccgacttagccatgatccggatccggtgcaagtagccggcccgttcggtaaccgaaacggcgccccgcgcgtccagcaggttgaaggtgtggctgcacttgaggacgtagtcgtaagccgggtgcaccagaccgaggtcaattaagcgcttggcttcttgttcgtaatccttgaagaattgcaagagcatgtcctggttgctttcttcaaaagagtacttggagtgttcgtattccggttcttggaagatgtcaccgtacaaaacgccgtcggcccattccaggtcgaagacggagttgacgttttgaatgtattcggctaagcgttccaacccgtaggtaatttcggaggcaaccgggtccatttgtaattcaccgacgacttggaagtaggtgaactgggtgacttccatcccgtctaaccacacttcccaaccgaccccggcacaacccatcgacgggttttcccagttatcttcgacgaaacgaatgtcgtgttctaagggttcaatccccaattcacgcagggagcccaagtaaagttcttggatgttttccgggctcggcttcatcagtacttggaactggtggtgttggtacaaccggttcgggttttccccgtagcgcccgtcggccggccgccgggacggttccacgtaggccacgttccacggttcgggaccaattgcccgcaagaaggtatacggactcatcgtcccggcccccttttccgtgtcgtaggactgcatcagcatgcaaccctggctcgcccagtacttttgaagcgtgaagataatctcttgaacactcagtttctttgccattgtcttactcctttcaaacgcaaaaacgcccccacaatcaccggtttaaccggtcattgcagggacgaataacttcgcggttccaccctgctttcccagggaggtgggacagcttcgttaaggcaactcgggagtgccaccaggttcacgtcccccggggcttgcaccctcccccggtcgcttcatggacggctgaaccatcttttccgtcatcgttgcagatctttaattaacactttttaatgatacgaacgtcacctagaaaagtcaactcccggccggctttttttcgtcgtccgtccccggattctttctggcggtcaagagccggttggtccaggaatccatttcgttgatgaagcgcttggacttaaggcgcaagcccaactggtcgtcgtagattttgtccagcgtccgacctaattgacgcttggtcgcctcgtctacgtgtacctgatcgaccttggccaggttaagggtcgcaaacagccggaggtaggcgacggttttgggggtgaggtggaagcggtaggggtcctctgcaaagtgatggaggcacagcatcccgcccatcttttccgagtaatccagcggcaaatcactgcgcccgcacaccacgcaccggtcccagaccggggcgatcccgaaccggttgaggagttggacctccaacacgttcacgactacctgggggtcgcgccccgtgttgatcaagtttagggccgccatcacctgcttgtaccagccgcccagcgcccgcccctcttcaaaggcctggtcgaccagttctagcaggtaagtcgcgtaggcgttgcggtttaaatcggcgccgatcccggttaggtggtgggtttcttgggccgagacgatgtaagacaagccctcgtcggcaaggacccccacgtagctgccgtaggtgaagggtaaaatgtctgaagccaacttaaagcccttgcgtttggccccgcggacaaaaaacatcagcgggccgcgccggtccgtcaaaatcttaaccaggaggtcgcgttcccggtagtcgcgccggtacatgatcaccccttcaaagggttcgttgacccgggccatctgaattcccccttaaaaaagtgggtgggaaataacctctttgccaggccgtgcttagacactaggcccgcggttatttcccacgttatctgtctaacattttcgaatacaattagtaatccgtttgccggtaaccgtagtcctttaacatcgccgacttatcgcgccagcccggcaccaccttgacccacagctgcaagaagaccttgtcacctaagagggcctgaatgtcttggcgggccgcggtgccgatctttttgagcatcgaaccgcccttgccgatgatgatccccttttggccggggcgttcaacgataatgttggccgagacgtgaatcgtttcatcgtcttctcgttggatcgaggtgacgtcaatcgccaccgagtgcggcacttcctccctggtatttaaaaagaccttttcgcgaatcatttccgcaatcacgaaccgttccgggtggtcggacacctggtcggctgggtagtactgcgggccggtcggcagttggtccactaagtcgttaatcagggtgttgacgttgtttccctgcaaggccgagaccggcacgacctttttgaacggcagcgccccttcgtattgggcgatgatgtccggtaagtcgttggggttaacctggtcgatcttgttgacgaccaggtagatcggctgttgcaccttctttaagcgctcaatgatgaagttatccccggccccccgcttttcattggccggtaccacgaagagaatggcgtcgacttcatctaaggccgacagggccgagcgttccataaagtcgcccaggcgggtttggggcttgtgaatccccggggtatcgatgaagacgatctgggcctcatcgctagtgtagatcccctgaatcttgttccgggtggtctgggcgacgttgctcatgatggccaccttttggccgaccatgtagtttaacagggttgacttgccgacgttgggccggccgatcagggccacaaagcccgacttgtaatttggattatccatttgatcctcgtttctaattcagtagttttaataggtgggggacaaagattaagaggccaaccaccacggcaaaggaggcggcacacaacaccgcccccgccgcgacgtccttagcgtgcttggcgtttagatcgaagtggtggcgcacaatcaggtcaacgagggcctccaccaccgtgttggtgaactccgctgagatgaccgtgaagatcgctaacgccagccacagccattccacggttgaaatgtgcaaccaccagccgcaaatcacggcgagcacggccgccaccaggtggaaacgcatgttgcgctcttgtttaagtacttggcaaacgcccgcccaagcatggcgtaatgattgggcgaaggtgtggtttttttcggtttgcttaccggctgagtccgaggccatctaaaatctcctcctgaagggtgaacatctttttctcatccgccggctcctcgtgatcgtagccgttcaagtgcaagaagccgtggaccagtaagtagcccagctcgcggtctgccgaatggttcaaaaagagggcctgttcggtcaccttatcaattgaaatgaccaggtcgcctagttcaacggggagctcagcgcggatttctgcaggcaggttggcgaggtcatcgtcgtcttcaatcgcaaaggaaattacgtcggtcgcccggtcaatcccgcggtaatcacggttgagctccctgatctcggggtttaaaacaaaggtcaatgacatttcggcttgctcggggacgtctagtcgctccgctgcttgggccaaggccttctccgctagccgttcttgactgggttgtaactttccttcggtatgatcacgcaactgtaattccattacttattctcccgcacctgttcttcatcttcttcgtaggcggtaatgatcttggcgacaactgggtgacgcaccacgtcggccgccccaaaggtaacaaactcgatcgaagaaacgccccgcaggatccgccgggcggcaatcaagccactcttagccccgcgcggcaggtcgatttgggagacatcaccgttgacgaccatcttagaaccaaagcccaaccgggtcaagaacatcttcatctgggcgttagtggtgttttgcgcttcgtctaaaattacaaaggcgttgtctaaggtccgcccgcgcatgtaggccaggggggcaatttcaatcgtcccccggtccattaggcgttcggtgtgttcggccccaaaaatcgaatttaaggcgtcgtaaattggccgcaggtaggggtcgaccttttccttgaggtctcccggcaagaaaccgaggctttcgccggcttccaccgctggccgggtcaggataatccgttccacttccccccgcttgaggaccgccacggccatggccacggccaggtaagtcttcccggtcccggctggcccgatcccaaaggtaatgtcatttttcttcatggcgtgaacgtactggcgttgaccaaagtttttcacccggatggcctgccccttacggtcgttgatgatcgtttccgaatagaggtccttgaaatactcaagggtcccccggtgggccatcttcatcgccgagacgatgtcggttgacgagatctgaatcttttgttcaattagtcccaccagttggtttaataccgcctcggtcaggtgaacgtcctcggcgtccccctggatccgcagctgatcgccaaaggggttgatcgaaacgttcatcccctcttccagtagggcgacgtacttatcttgggtccccaagagggccacttcaatttccgggctgtcaatttgaaagttaacggccaaagtttcgttttcgctcaaaaacggattctcctttacaacgccaagcggcgcaaatgatttccttaattttaccgcggccaagcgcttggatgcaagattttggccgaaactaaaggggccctggcacgaccaacctggtcaaatgcgcggccccctctctagttgttacttggcttgcaaagcgtccttgacggtttggttaactaacttcccgtcggccttgcccttcacctttggcatgatggcgcccatcaccttaccaaagtccttcatgctttcggccccgacctgggtaatcgtttcgttaacgaccttagccacttcgtcagccgacatttgttccggcatgtacttagcgaccaccgctaattcgtggttggtttggtcaatcaagtcctggcgcccggcgctggtaaattcttccagcgattccttgcgttgcttgtattcccgggccaagacggcgttttcttcgtccggcgtcaaatcgtggcccacggcgatctgttcgttttgcacggccgcctttaacatccggaccaccgacagggtcgccttatccttttccttcatggcggtgaccatgtccttggaaagttgttgtaataagctcatcatcaatacccccattttatgtaagaaaaaactcccaccagaaaccggcgggagcttttcgcgactagtaacgacggcgcttgttcttgcgcttccgtgccgcttcagactttaacttacgcttaacacttggcttttcgtaaaattcacgcttgcggtattcttgcagagtcccgttacgtgaaacggtacgcttaaagcgccgaagagcatcgtctaacgattcattcttacgaacgatagtttttgacattgtaaaattccctccctccgagcttaagatcgtactgtcatgaccaagttctcctggcctttccactacaatgaccattataaacaagcactaattcaccgtcaatcaattttttagacgttttcaggattttctttcatcaagtagtccaacagccggttcatgacggcctggttgtccgccggaaccccgtggttgacgatttcttccgcagtctggtttaaaactgacccgttagcgtaggccccgtcgttagcgcacatttcccgtacgttcaattctaagggctccaagtgaaactgtaggccaatcgccaggtcctgatagacaaagccctgttcctgcaggtacttggacgaataaagcaggtccgccccttctgggatcgtgaacatctgctggtgccagtgcagtggcgtggcaacctccggcagaccggcgatccggtcgctttggcgggtcacttctagccaaccgacttctttagccggggcgtcttgaacccgcccgcccaaaattagcgatatttgttgggcgccaaagcaggccccgaagaccggcttcttcgccgttagcattcccttgatcagggcccgttcgtctttgatccattggtcgtcatcgttggggctagccgggctgcccaaaacaactaacaggtcggtttcatcaacggttggcaacaggccaaagtcgttggggtggtagatggtaacggtcgcttggtggtcgttggcccaatttaagatggcccccggtccttcgtcactgacgtgttgtaaaacgttaagtcgcatgtgcgttcctccggataaagttttctccattatactcaccgccccgtcacggtgccactagggaattaactaaaagaacgaagtgcggaccaaccatcaagcaggccgtgggctaaggataggtcacaggttagcgtgccagcggtgttctgttaccagacttagccactaggcctgcagttgggagcacgttatcttggaagtgggaaatgaccttctcgacagaccgtatgactaagctagggggaagattggtgccttggcaccgttcttcgcccgtacttaggcactaggcctgcggtcattttccacgttatcggaagtgcggaccaaccatcaagcaggccgtagtaaggttcggacacagagcaaaaggagttgttgcccaacgtcaatcttttcataatccctcatttgagacacgccaaattgatagatttttcctgtgcggtttgagatggaagtgcgactaacctccttgacgggtcgttgggctaagatagggtaaatagttggcgccccagcgccgttctttgcccgtacttagccactagacccgtggttaggagcacgttatcggaagtgcggaccagccaaaaaatagccgtcaggcgtcgtttcaaacggcacccgcggctatttctactattaatagtttggttattcggcttcctttggcgcctcttcaacgtttaggtgcaagacctccagttgttcatcgtcaaccgtgcccggggcagcggtcagcggttcaacggccttggagttctttgggaaggcgatcacgtcgcggatcgagtcggcgtgggccaacagcattacccaacggtcgagcccaaaggccatcccaccttctggcggcatcccgttttctaaggccttaatcaagaagccaaagcgggcctgggcggcttccttggtgtaaccgagggccttgaagaccttttcttgcacttctgggtcgtggatacggattgagccaccaccgatttcgttcccgtttaagacgatgtcgtaggattgggcgtgggcctggtgcgggtcctcgccctcttctaagtacttgaggtcgtcttcgtttaacatcgtgaacgggtggtgagcggcgatccacttaccaaagccttcgtcgtattcaaacatcggccagttaattacccagaggtagttgaacttgttttcgtcaatcaagtccagttccttggcgatgctttcacgcaggtaacccaaggagtcgcagaccacgtggaaggagccggccacgaagaggaccaggtcccctaccttggcgcttaaacgttcattaagggcgttggcgtcgtcatttaagaacttggctaccggaccgttgtaaccctcttcggtcaccttcacccaggctaagcccttagcgccgtaacgcttgatgtaatcttcttttttggtgatgtccttgcgggagtacttgtcggcgccccccgggaccacgatcgcccggacaaagttgccgtccgccaccgttgccgaaaagaccttaaacgaggagtccttaaccagatcggagacgtcttgaatcagcatgtcaaagcgggtatccggcttgtcggaaccgtacttatccatcgcctcttgccattccatgcgcgggaacggggtcggcacgtccacgccaacggcttctttcatcacccgcttgatcaacccttcggccattgcttgaatttcttctggttcggcaaaggacatttcggtgtcgatctgggtgaattccggttggcggtcaccacgcaggtcttcgtcgcggaagcacttagcgatttggtagtacttgtccaccccggcggccatcaggagttgcttgaagagttgcggcgactgtggcagggcgtagaagtgacccgggtaaacccgggacggcacgatgtaatcgcgggccccttccggcgtcgagcgggtcagttccggcgtttccacgtccaaaaagtcgttattatcaaagtagttgtgaacaattgaggttaccttggaacgtaacttcaagtagttcatcatctttggccggcgcaagtcgacgtagcggtacttcaagcgcaggtcttcggaggcgtcgacgtcgtcttggacttcaaacggcggggtctgggacttggccaggatcttagcttccttaacctcaatttcaatcttcccggtcgcaatgtccgggttgacttcggcccgggcgcgaaccagcccgcgggcctctaaaatgtattggttacgggcctggttagccacttcaaaggacgcctggtcttcttcttcgttaaagaccagttggacaatcccttcccggtcccacaggtcgataaagatcaagcccccgaggttacggcgcttagccacccaccccttaacaacaacttcttggccgatttgttcttcgctcgtgcggccagcgtaattggttcgcttcatgagttaaccttcctccacgtgttcttgataaaccttaccaaagtcggctaagcaatctgccaggggaacggagacttccttaccggttgccatcaccttaaagtggaccgtcccctcttcgatttcgcgttggccgaccgtcaacgttaccttggcaccttccttggccgccgtcttgaactgggcctttggcttacggtttaggtagtcgcgttcggccaccagcccggcatcccgggcggcggttaccagccggaagctctccaggttggtcgcttcgccgatcccgaccacgtaaacgtctaagccgtcttccgttggcatttcgaccccttcgtcgcccaacagcaagatcagccgttccagaccaatcccgaagccgacgccgggttcgtccgggcccccgagttcttccaccagtcctgagtatcggcccccaccgcagatggtggtgtagccgtggcccagtgacttggccttaaccattacttcaaagatggtgtggttgtagtaatccaagccccggaccatcgtagcgtcaaccacgtagtcgatccccaggctgtctaacatttccttaacttggtcaaaccgttctgcggccgccggggtcaggtaatcaaggattgacggggcgttttcaacgaattgctggtcgcgttcgtccttagaatcgagcacccgcagcgggttcttttccagccgttccttggagtcttcgcttaattcatcgtagtgaggctttaagtagtcgatcaacgcctggcggtagttggcccggctttcctggtcccccaaggagttaacggccacccgcaaatcagagaggccaagctttttaaagaaccgcagggccatcgtgatgacttccacgtccacggccgggttgtcggccccaaaggcttccaccccaatctggtggaattcacgttggcgccccgattgcggccgttcgtaacgaaacattggtccgatgtagtagaccttgtaaggcttattaaattccgggccgtacagcttattttcgacaaaggcccgcacgacgccggccgttccttccgggcgcagtgcgatgtggcgatcccccttatccttgaagtcgtacatttccttggtcaccacgtcggacgtgtcaccggccgaacgggagaagatgtcgtaggattcaaagagcggtgttcgaatttcttggtagccataagttttaaaaatttggcgggcttggccttcaacgtattgccaggtttgactatcccctggcaagatgtcggccgtcccttttggccgttggtagcgcatgtgtttcctcctcaggctctcaacaaaaaaagcacccctgcaaaagacaagggtgcaaaatgcacggtaccaccttggtatcaactcgtgggtaacgccgaatactcagcggggcaaacgcccagtctccaaagggtcactcaaccagcgcaccggtgggtcttgcaccaccacccactcgctatcccgggccggttgatcattctttttcattgacagtcttaattaaatttacttctcttaccttactcggcaactgggccgccgtcaagcgttgaccgcgcctttttaaagccttcacaaaatccaccttcttttaaccattattggtggtaagatttacgataatacttttaaattcgaggggatggattcgatgtttttaattgacaccagtcgcaacggccagcccgtttataacgccttggttaaccagtcgttggacgcttacttgatcaacgacctccacttagaggggcacggcctcatttgttatatcaacgacccggccgtcatcattggtcgctaccaaaacgcctacgccgaggttaacctcaattatatgaaggaacatcaaattcaactcgtgcgccagaccagcggcggtggcgccgtctaccacgaccggggcaacgtcatctttgaaaacatcgtcgtgggcgacactagcggctttcgtgattttcaacgggttggcgccccgattgtcgacgccctccacgacctggggattaaggatgccgaggtccggggccgaaacgacatggctatcaacggtaagaagttctccggcatggcgatggtcaaaaagggcgatgcttacgcagccggggggaccctgatgtttgacctcaacggtgaagttgccagcaccgttttgactcccgacattgggaagttggaagccaagggaatcaaatcggtggacgcccggatcaccaacatcaagccctacctgcccgcacaataccaatcttggaccagcgaggacttcaaaaactacctgctctgccacctctttggcgttgagcgcctagcagacatcccgacctaccacttaaccgaccaggattgggcggccatcgacgcccggttggataacttgtacggtaccgacgagtggaactacggccacaacccgggcttctcccactacgtttcccaccacttcccgatcggcacggtctcgtttaacttcaacgtcgaaaaccgccacatctcagaaatccgcctcttcggtgacttcttcaccaccggcgacccccacctaatcgaggcggccctggtcggcgtcgaatacagcgccgaggcgattaaagccgccctgagtaaggtcgacatcgaacagaacctcagtgctgtttcagtcgacgagctcaccgccctgcttatgcgggtcctttaattcattaatcaaatttgtcactgcggaggttatcattatcaaaacgctacgtcactcacggttggcgatcctcaccgtactcattgtcattgttcttaccattgccctggtcttcaagttgaccaactcgggcacccaatccggttcgctctttagttccggggagttgtcgatcaaccccagcaaggttaccgtacgtaagggcccggggcttgattactctaaggtcaaagttaccaagacctttcagtcccagattttgcaaaagcgcaacggctggttaaaggtccgcctagctaacaacaagaccgcttgggtgccgtcctggcaggccgaaaacacggttgcaaaaacggcggccaccaagttacctaacgccacgatcgtcattgacgccggccacgggggcaacgactccggggccctgtacgacgaaagtgaaacctcttcttactacatggaaaaaaactacacccttaagttggcgaagttagtggccaaagagctccgggcccggggtgcgcgggtcatcttaacccgggataacgaccgctacgtcgacctcaagtcccgcccggagacggccgagagcatccacgccgacgcctttatctcctttcactttgactcctcgccgtacgcaaacgaagggacgggggtaaccacttactactaccacaagggtaacaacagcaagaagctcgcctcggccatcaacagccagtttaacaacttaccgctgcgcaacaacggggtcgacttcagtgacttcttagtcctccgtgataacacccgcccggcgatcctgtgtgaaatgggctacatcaacaccgatcaggacttcaagcagattaccagttccacttaccgcaccaaggtcgctaaagacatcgtcaacgggttagataaatacttcaaggaagtgaactaaaatggatcaaacctggctcaaccaactgccgctccccgaaccactaactagctggcaaccggtcagcggtggcgacattaacttggccttccggctccaaacggctaccaagaactacttcatgaaggtgcagccccagcagccagcctcctattttgcccacgaaattaacgggctaaagcaactgggccaagccgtcaacgccccccaccccctttttaacggccaaattaagggcgacgcctttttaatcctcaactggctagatgaaggccacggggcgcaagccgacctcggccaggccgtcgccagactccaccaagtgcaccacgaccagtttggcttctttgaaaaccaccacaccaaggccctggtcaaggacaactcctttaacccctcctgggccgacttctacctccaccagcgcttggaaccggaagtagcaacggctgtcgcggcgggccggtggaacgactggcgcaacgcccacttcaaacggatggccgcccagtttgtcaccgattgtcagcaacggacgatcaccccttcactgttgcacggcgacctctgggcgggcaacttcatgttcaccgccgacggaacgcccaccctgatcgaccccgacgctgtctttggtgaccgcgagtttgacctagccatgacgaccatcttcggtggcttccgccaggccttttaccaggcataccaagccgcctaccccctggatgcgggctggcaaacccgcctgccctactaccaattctactacctgtgcatgcacctaatcttatttggtgagggctacgggccggcggttgaccggatcttagagcaatactaaagaagggtaactaagcacccaagagacagcaagaggctggaaccacgtggctccagcctcttttttggaattattaactaccggttatttcccactccccgcagcttttcggcgaccacggcaatgtcttggggcagcgtggtgcaacaccccccaatgattgcggcgccggccgttatccagtcgtcaatcgcgttaacaaagcggggcgtcccctcttcaaagcgccactgcttgacggtcgggtcgtaggtcgcccccgagttcgggtagacgatcaccggcttgtcggtgacctccttaatcgccttgattgccggggtgaccaggtctaagccaacgcagttaaccccgacggcaaagacctgggggtccttagtgacgacctgaaccgcttcttttaagctcgttccgtcgctcaggtgctcggcgtcccgtagcgagaagctgacgtaaaccggcatcgtgggctcgagcgtctttaaaagggcgaggatggccacgacctcggtcaacttaggctgggtctcgagcgccaggcaatcgaccccggtcgccaaaatggccgccagccgcggtaagtgaaagttttgtaactggatggcggtcaaatcgtaatcgccccggtattcgctcccgtcagccaggtaagccccgtacggcccgatcgaaccggcgacgtagttatgcttaccggtttccttctcgtaatcgtcccgggcctgattggcgagctgaacggctcgtttgattaaatcgcgggcctcctcctcacttaacccgtggcgcaccagggcgtcgacgttggtttgataggtgtccgtgatcgtcaaattggcaccggccttgaagtaatccaggtggacctggtagaccaagtccgggttatcgattaaggtttgggcggtccagaggtcactattggtcttggccccggcaacctccaggggcgttgacatggagccgtccaagacgagcggtccctgagctaatctttctaaaagtttcatttccgcaccggctttctagtgttatactaaacgaattgtaatagttttttaattaaaatacaaggattgggatgatgcactgtgaaaattgaaccaagcagcgagggcgaacacttagagcgtaagatggaggcccgccacatccagatgatctcgctgggcggggtgatcgggaccgggctcttcctgagctcgggttacacgattaaccaggccggcccggtcggcacgatcatcgcctacgcggttggcgccgtgttggtctacgccgtcatgttgtgcctgggcgaactatcggtggcgatgccttacaccggctcctttcacgtttacgcccgtgaactgatcggcccggccaccggttttacggtcgccctcttgtactggctaacctggacgatcgccctggggtcggagtttacggccgccgggatcatcatgaaggaatggttcccccacgtgccgacttggtactggagcctggccctgatcattttgattctcctgtccaacatcttcaccgtccggatctttgccgaaagcgagttttggttcgccgccgtcaaggtcttggcgatcgtcgccttcatcgttttgggggcgctagcaatcgttggcctgatccctgtccagggctacacccacgccccggggctgacgaacctgaccaaggacggcctctttccgaccgggatcggcggggtcttcaccaccatgctgacggtcaacttcgccttttctggcaccgagttgatcgggatcacggccggcgaagctaaggacccggaaaagaccctccccaaggcgatccacaccaccctgtggcggctggtcctcttcttcatcggctcgatggtcgtgatggcggccctgattccctacaaacaggccggcgtcacccagagcccctttgtccacgtcttccagatgatggggatcccctacgccgccgacatcatgaacttcgtcgtcttgacggcgatcatttcggcggccaactccggcctgtacgcttcaacgcggatgctgtggtcgctgggcaacgaagggaccattccgcgcatctttaccgccaccaacgcccacggcatcccggtcttagccgttatcttcagcatgcttggcgggatcttatcgcttttatccagcgtttacgcggccggcacgatttatttggtcctggtttcgatctccgggctggcggtggtgatcgtttggatggcaattgcgatttgccagcttaactaccggcgccgtttcttagcggcgggccactcggtcgacgagctgaagtaccggaccccttggtacccagtcgtcccctggttcgcctttttagccagcctggcctcttgcctactaatttggttcgacccttcccaacgggtcgccctttactggacggtgccgtttgtcgccctttgttacggtggttactaccttgcccgcttcctcaaacggagaggggcgctgccagcatcacccaaaaatcgtcactaaatctctattgacatttgattaaaatggcgatttaattagttttaaattaaaagtaattaataaatttcgttgatgagaagagtagcgacggcggtcacctacagagagccccggctggtgagaggggtgctgatcaaggtcgtgaagatgatctcggaggaagagcgggggtcctcgggctacccgctccggtggcacccgataccgtgcgggggatgtatgtcctcgctaaggctgctttggcagcgaaattgggtggtaccacgaagtcctcgtcccatggttgtaaaaccgggacgggggctttttttgatttagaaaggggtttttgaaatgacagcgttcgccactaacggcctggccagggcccaccacacctggtcgacaaccacccccgcaccgggggcgcgccaaatcctgatcgttaacctgatgccgaccaaggaggcgaccgagctccagttcctacgcttgttagacgccaccggggtaatctgcgacgtcaccttcgcctacccggctagccaccaactccaccaccagcgggcggccgtcttaaagcactacctaccgctggatcgactctgggggacccgcttcgacgccctgattgtcaccggcgccccggtggaagaactctcctttgaccaggtcgactactgggccgagttccaacggctggtggcctggagtaagacccactgccggcgggcgatctttgagtgctgggcggccctggcggcgctcaacgtccgctatcagatccccaaggccccgctgccccacaaactctttggtatcttcgaggcccgggttaacccagcgagccccctctttggcggcctgaccaagctccggatgccccagtcgcgccacagcgtcctccaactgccggcgaccctccccgcggacctgcaggtggtcgctaagagtcagggaattgctgacggcctcttgctggccaccaaggacacccgggagctctttatcaccggtcaccccgagtacgccactgacaccttggaccaagaatttcaccgcgaccaggcccggggacggaccattaacccaccgcaaaattactaccgccaccaccaggccgttaattcctggcgtcccaccagctgccggctctacgccacctggctaaccatttaaggaggaatgaacatgaataacaaacggatcgccctgctgggcttgggcacaattggccaggtggtcttcgacgaactggttgcctcaaccaacggcgcttggcaattagcctgggtagtggttaaacaccccgaacgccatcaaaccgtcttactccccactggcgcccaattgacgaccgactggcgccgggcggtggaagacccgaccgtcgacgtggtaattgagctaatcggcggtattggggtcgccaaagaggccgtcacgtccgccctcctccacggcaagtaggtaatcaccgctaataagggcctggttgccacggccggcaccgaactcgaccggctagcggagctgtacggcggcgccttgacttacgaggcggcggtggcgggtggcatcccaatcatccgcacgatcaacgaggggctggcccccgaccggatccgccgggtcagcgggatcctcaacggaaccagtaactacattctcaccgccattgaccaggaggggctctcctttgacgccgccctaaaggaggcccaagcaaagggctttgccgaagccaacccgattaaggacgtgatcgggatcgacgccgcctataagctaatcatcttaaccaagctgatcttccaccggaccctgtcgctcgcccaactagccccgaccgggattgaccacctttcaccccgcctgtttgcggcggctaaggaatgggggctaaagatcaagctgttagcttcaacttgggaaagccggggccaacttaactaccaggtggccccagtggcacttaacccttcccaccccctctaccaagtggacggggtcaccaacgcggtcgtgattgacagtgacctggttggtacctcgacctacctcggccccggggcgggcggtaaggcgactgccaacagcgtcttagccgacctggctagcctgagtcgcggcgagcagctgaccggctccagcgcctgtttgcgcattgaaaacgggcgaccgctcaccaagcaacgctacctggtcgttaacccgactggactgccaaccggcctgcagttcagcgatcgccacgccactagcgcccttacccccgcgttaaccccgacagacttgcaacggctccgggccacgaacccggggctagagaccttggcactgggagaatgaacgcaaaaaaggaacctgcgcaacgcgtgcgcaagttcctttttaattgcctgtggtttgccgggcgcccaaccacgggcctagtggctaagtctggccacagaacaccgctgacgcgctaatctgtgtcctattcttagtcatacggcctgctttacggttgggtcgcacttcctttttattgggccgtgtagcccccatcgacaacaaactcggagccggtgctaaaggaggccccatcggaagcaacaaagacagccatcttagccacttcttccggctttcccagccggcccattgggtgcttgtcgatgtagaattgcttggtcgcatcatcgaggtgatcgatcagcggcgtggcaattaccccagggtgaatcgagtttacgcggatggcgtaacccttttcggcacactcaagcgctaccgacttggtgaggagacggacgccccccttagcagcgttgtaggccggaacggttgggtcaccgatcatcccttcgatcgaactaatgttgacgatcgcgccaccatgttccttcatcgctttaaccccgtacttgcaacctaacatcgtccctgttaaatcgatggcgatttcgcggttccagtgatcgagcgtcatttcctcgatccccagcggaatcccaattccggcgttgttgacaatcgcatcaagctgcccaaatttttcaacaacggttttggtggcgttttgccaatcttcttccttggaaacgtcttgggtgatgaacaaagaccgttcaccgaggcgttcttgaaccgcttttccttcgtcttcgtgacgaccggtgaaggccacccccttggcgccttccttcaaaaacagctcggcgatggctaagccaatccccttcgttcccccggtaaccaaggcaaccttattgtcaaactgtcccatagcagcatctcctttcgatcctctgcggatttcattaattacattatgccatggtaacggtttctttgtaatgatatttatcgattaattaataaaaagtaactggcaccctactaaacggaccgcatggttatgctagggaaccggctggcaccccttcttacccgtactcagggccacgttagctgtgtaaccacaaaaaaaagatgcggcaaaccttccgtttcccacacccttatttcacttcctatcaaaggagagcgtacttcttatcgagcaaattgagtcgcacttccaataacgtgctcctcaaccgcagacctagtggctaagtccagccacagaacaccgctggcgcgctaacctgtgtctaggtcttagcccacggcctgcccactggttgagtcgcacttccaataacatgctccccgttatttatcgttagtgatgataatgtcggaagccttgacttcactaccgaagtacggcttgagttccttgttaaagtcggtcttaaagaagccgtcctcgttgagcttggtgatttccttgttggtccagttcaacagtgacttgttgcccttcttgacggccggggaaatgtcttgggaaggcccgagggtcttgatgccgaccgtgtacttcgggttcttcttaacccaagcgtaaaggtaggagttatcatcagccaaggcgttagcccgcttgttctttaaggcgttaaactgttgggtcttggtgtcaaacttcaagatcgacttgatgccgagcttggattggttggaaacgaagtagttttcggccgtcgtccccttgttgatgatgatgctcttgttcttcaattggctgaccttagtgatcgggtcggacttcagggaaacgaccccgattgaaaccttcatgtatggcttagcaaagtcaaccacttgcttacgttcgtcggtcacggtgaagtttgccaagaccaggtcggccttattagaattcagggtgtcgacccggttgttagcgttcacctggacaaacttaaccttgaccccgaggtccttggcaatctgccgggctaaccggacgtcgtaaccaacccgcttaccgtccttgttgacccagccgtatggttgtaagtcgccaaaaacggcgatccggatgtaaccgcgctttttaatcgccgaaacggaactttggttgctgtcggccttggctgaagacaggccggcaaaggaaacgagcgaaaagatactcaggacggttaacaaccctactattaatttttgaatcttcttcatttgctttctcccttattaaaaatccatactttccaagaaatcccgcgcccgtttggtctgggcgttggtaaagaattgctgacccggggtatcctccaaaatacgcccgtcctctaggaacagaacccggtcggcaatttgggcggcaaagttcatttcgtgggtgacgatcagcatcgtcatcgacccgtcgttggccagttccttgatgatgtctaagatcccgcggaccatttccgggtccagggacgccgtgacttcgtcaaagagcatcacctcgggctgcaaggccaaggcacgaacgatggccacccgttgtttttggccccccgacagctggcgcgggtaggagttggcgtgctcctttaacccgacccggtcaagtaaggccagggcctcttgctccaccgtcgcccggtcgcgcttttggaccttggtcggccccaacaaaatgttttctaagaccgtcatgttcgggaagaggtcgtagttttgaaagaccatcccgatcttttggcgcagccgttgccaattcttctcgctgggctccaccttggcgccgttaaagacgatctcgccgtcacgatactcttctaacccgtttaaacagcggatcagggtgctcttccccgaccccgacggcccgagtagagctaacacctcgccctttttgaggtcgaagttgatgtcgtgcagggcctgccagtcaccgtaaaacttatttaagtgacttacctttaaaatttcttccgtcatacgctcctccttactgccgggcggttagctttcttgcccacagcgacaacaggtagtcgacgatgaagtacaagaaaaagattaacccgtagacccaaaacaccccggttgggtaggttgaattgttggcttcgatgatctgttgaccgacgttgatgacgtccatgatgctgatgatcatcaacagggaggtcgttttgaccacccgggtcgccaagttgatggcggccggtacttccagcttcattgcctggggcaagaggatgtaacggaagatctgaaagcgggttaagccaattgccaaccccgattcgcgttggtgttggggcaccgattgaatcgccccgcggacgatgtcgctaaattcggcggccacccacagcgaaaaggcgagcaccgccatccaatccgccggcatgttaatgtgcaactggcgcggcaggatgtagtaagccaagaataagagcaccaccgttgggatgatccgaaagatttccaggtacaagcgcaggatgaaacggagcaccctgctcttggtcgtccgcaagaccccaaagaccgtcccgacaatcaagccaaagaagagcgacaccacggcgatccaagcactgacccataagccgcccatcagccgggagaagttggatccctctaacaagacgttaatccccgaatgtgccatagcgcaccctcctttccagccagttcaacactaagatcagcggaatcaagataatggcgtacccaatcaccaagaccaacaggtattcattggaccggtagtagagccctatcaagtcgagggccgtattcgtcaattccggaatcgcgatcaccgaaaaaatcgaggtttccttgatcaaaaagatcacgttggccgccaacgccggcatgctcagggcaaacccctgggggaagacgacgtagcgggccagttgccactggttcatcccgatcgccttacccgtttccaactgccccttgctaaccccggcaaaaccaccagtgaacccctcggccatgtacgaaccgccaagaaaaatcaagccgacaatcccgcaggtcacggcgttcatcttcaaaccaatcaccgggaaggcgtagtacaagaagaagagctggattaacagcggggtgttacgcgaaatttccacgtaaaccgtgcagacttggcgtaagacgggcacccgaaagaactgaaccaggctgacaatcacaccgacaatcagcgagccgacgatccccaccgccgagagccacagggttgcaatcaagccctgttcaaacattggtaagctttgctgaattacttcccaggacacaaacaaaccctctttccattcaatttcatcaaaaaagcccctgaccacagtgtgatcaggggcttcccatttctcttacttaaaataagtacgaggatttaacggaagtagcttcaccacgctgcaagtgtatgccaaagaacatgttgcacatcatcgtacaacattgcattgcgcacatcatttgcagtttagtagctggcatggtgaacattcttcccttctttgatgatattgtaaggataagccctctaataattaatgtcaatatctaagtttattctaattttaacttttggtaagttaattggttgggatgatcgagcagcgcccctccgttaatggcgagcattgacgtgggggcggagctattggatcaaccaatatatctcttgaagtaccgcttcttttttcacaattaaatccaccaacgcagcaactttctccttcggtagaaccattaatagcttctcttgtaacttttcagaagaaagcggcctatttggtgatcctaatggcattactactaactgtttaactattcctcttctagtaacagtctctacaagggtcggccgctttgtagctgacgtagttgccaaatcgtgttttctgacaatcttggccacgtctattttaaactgactgtcaacgaatctcgccgtaaaatcagcatctttaacatcaccaaatttaagtacctgccagatgatgaactcaattgagaactttgactcttgaccagtttgtggccattgctgatttagtgcccgatcgccattaggtggatagtggacaacaacttgaacacaatctgaccaccgaactcctttgttccataacatcttcgctgcttcataaccggacaaagccgctgaacaaaagggatgtactttaaaccatagtcctggtttgttgatttgtcccggttgataccaatcgttaccaagcaaactaaaactggtttcgttaaagcctaaagtagccccccagaactgcaaggaatcttcatttgcagtaaaggagcctctgctctgcgagagtataaaggcggttaccgcgttacgtgctgccaaccctgcttgcaacggtttagcatccgtcccattttgaaacgacatcccactcgcttgacttgtagcaaatgacaatgcccgagtagtctgatccacagaggcattagcaaggttacacagtgctcccgttgccgcaatcgttccaatggttgctgttgagtgccacccctgaacggtatgatccggatttaaggccaatcccaacttccctgccaattcaactcctgcgatgaaagcttggagtacttgccgcacctggctacttggtggagctatggcaaggagtgctgagtagatcacagcactagggtgcccacgaaaattagcttgaacgtcatcaaaatccagatagtgagcagcaaagctattgatcagcgctgcccgctctggtgtagtatgtaaccccaaaagcgagtttactttccctccttcttgctgccataaccgaccaaattcttgaacttttggttcctttctagcttgtaaaacacatcctaaatagtcgattaaagctcgtctagcttccttaattaatcttgaatcttcacttttttgctgtaattgcttcgcgactaacctggtctcgttcaagatcccaagccccctttgccaaaacccggcctgcattttttacaacgagttcaatccgttgactaatatttccaaggtcgttttccgcttttgcccattcatcaaggtcagaccgcttgaagtaatgatttacctcttcccgttggtagagcacttctaagaaattacggtgttgttcaattgcggtcatggcactctcataaactacttcgtgagctgtttgtttgccaatgatcgttcccaattcaaacataatcttttctgcaaacggtagtccaccttgtaaagcgatattctttttcatttgatcttcgttcacgttgagctcactgaggatatatgtagcattaacgatttgagcatctaagtaatttgtaatttctggtagagctacccactcatttcgccaatgaatcgcatctcgttccccatcaaagagcattgattggtgaattaacgctacatcgctaaataccggttgggttaaactagcaagcccctctagtaaagctggattacgtttttgtggcattgttgaagaaccaacttccccctttttaaatggttcggttacttcattaacttccgttttcattaggttaaatagctcatggccaattttccctaaggtcccggaataaatccccaaaacttctgcaatttcagaaagtcgatcgcgggaagattgccatgaaatattaggtacgtccaagcctaaacgagttaatacttccttttctacggcaggaccatcaccaccaaacgcagcgtatgttccaaccgccccgctaatactacccacaaaaacctggtgatcaattagggtttgtaatcgttggtaactacggactagttcatctaaccataccgctaatttaaagccaaaggtaataggaattgcttgaatgccatgtgttcgaccaatcatgggcgtttcacggtaacgttgtacttgctcagttaagacttcaattaacttttgtgtatgctccaaaatcacttcaaaggcttgcttagtctgcaacataattcccgtatcaacaatatcttgcgtagtaaccccaaagtgaacaaactcccctgcgctttcccctgctagatattgaagtctatgaatcaaagcaattagggaatgacgtttttcagcactctctcttactagcgcatccaagtcaaaattttccaccttagcaacttgggctatctgttcacctgcctctggtggtattacccctagttcaccctcaacctctgacagtgttgcttccactactaattgtgcttgcaatttgttgtggtcactccaaatttcccggatttcaggagtactaaagtttccttgcatcaattttgaatctaaaacactactcatctattttgcccccgttgttttcaattcactcaataaacgaagcgcagtgtagtaataccacttagcaccaacaagcaacccttcatcatcaacccgtaaatcagagtggtgccaatcagaattaccattactccccacaaaggcaaaaacactcggaattttttgactaaagtaggcgaaatcttcaccggcattagaaggtgttggttttaccaattgaaggtgcttttgagtttcttcgctaacgatttctgtaagcttaggatcattatcaacaacgttaggcccttcaatccactcaatttcaacatccactccaaatgacgctgcttgtccttcaataaccttgtaaaagcgttccttggcaacctgtcgtgcctgcttatcaaacgttcgtaccgtcccttcaaaccacgcattttctggtagaacgttccaggttgaacctccttcaatgtgagtaattgacacgactgctgttttctgtggatcttcattccgactaacaattgtttgaaccgctgaaacagtccctgctaatgcaataatgggatctttcccaaattgaggcattgccgcatgggttcctactcccttaaaggttactttaaactggtcaactgcagccatcagaccaccaggtaaaattccaatttcaccagtggctagatcaggcttgttgtgaaaaccaataattgcgtcaaccccttcgatcccccctgcttcttcaacttcttgggctccaacgtgagtttcttctgccggttggaagattagacgcacagtccccactagatccgcttctttttccttaagcactcgggctgctcccaatagtgaagccatatgaaaatcatggccacatgcatgcattaccccttcattttccgaactgtaagggagccctgttgcttctttaatagggagagcgtcaatatccgagcgcaaccccactactggtttaccctcaccaatttctgcaatgacaccagttttcaatcctactggcgtgataattcgataccctatatttaagaggtactcagtaataaaacgacttgtttcaacttcctgatctgacagttctgggtgttggtgtaagtaatgccgggtctcaataatctcgtcttttatttctgtaaagctactctctaccatttaaatgcctccaattatttttctaccgctactttttcaagtgaattaacgaaggaactgattcttcccgcaccacggccagaaagcaactcacttgctggtccctgatcaaaaatctccccatcttcgataaaaaacgcttggtcagcaatctgacgggcaaaatccatctcgtgagtgactaatatcattgtgatatgttccttagcaaggttggcgatcgtttgtagcacatcccctactaactctgggtctaatgccgaggttggttcatcaaacaagatcactttgggcttaaccgcaattgcccgggcaatcgatacccgctgctgttgaccccctgaaagggtgataggatattgatctgccacctgttctaatcccacttcagctaacacctcacgtgctaattgacgggcttctttttttggtaactgcccgtttaaaattaatggtgcggccacgttttcaagcgcagtcatatttttaaagaggttgaattgttgaaaaaccatcgcagagttctggcgaagctcctcaacttggcgcttatcaatttttcccgcctcaatctttgttccgttaacctcaattgttccttcagacggttcttgcagtaagttcagtgtccgcaaaagcgtcgtttttcctgaaccacttggcccaataaacgccgtcaccgttccctcttcaacatcaagattaattcgtttcaagatttgcttctgaccgattttcacggataggttccgagctttgattagtgacatatgcaatcctccgatatggtttttgtaaggccttttctaaaatcccctgcaaccaagagtaaataatgattaccgcccagtagagaagcccaatggcaacgtaagtttcaaaatatctaaatgaatcccctgcaagcattcttccttcagcgaacagctctgtaatccccaatgcaaaagcaagggaagtttccttaatcaaactaacaaaagtgttgccagttgcaggcaaggcattaactgttgcttgggggagtaagacatggaaaaacaatttggagcttttaatgttaagagacttccctgcttcaatctgtccttcatcaactgaaccgatagcggcacggaaaatttcagcgaggtatgaggattccttaaaaccgagccctactaacgccgctaacatcgctggaatacctcgcaatgcggggaaaatttgcggcaaaccataataaacaatgaacagttgaactagggttggcatcccccgaaataacgatacataaaacttggcaaacagccgtaatgccctaatcttagacagttccaataaggtaatcgctaaccctaatacgattgccaatgccattgaaacgacagccattaataaggtgactggaacaaatggtaataactgtccaaacaaacttataaaatatgagaaatcaaacttcatgttttcctccttgactgccttctaatggtttttgctaacaattgactttgcttttacataacgagcctcatccaaaactttgactaaatagactgtttggtgatctggaaactttctaaccgtctcaacttcatcaaacccaagcttttgataggtctttctcaaccaaggatgctctaatgcggttcctaaacttactgcagctgcttttaaatcctttgcaacatattcttgaataacccagtcaattaactctttagcctttccttgacgttgataggcgggattcgttgccacccaccctaagtgaggaagggcatatggtcctggattatttgaccacggtagccgaactgaaacggtggcaataatttgttgcccatcctttaccgcgaaggtcggggtactttttaaatgttcaatcactccttgatagctaaccgttgtagctccaaaatgaatcccaagtttctcatcaccttggtaagcttggtgaagaagttcttgcaatttcttagcatccccaactcctaagcgatcaaccatggttactctcctaactagttcttagacgtatcgtatccgtagtacttcttggaaagcttagctaacgtcccgtctttcttcatttccttaatttccttggagtactgctttgctaatttcttgcccttagcatcttttgagaaggcaatggcaaccttgttttccgctgcattccccttcaagatcttccagtcaagcttcttttgcttaatcgttgctgatagaattggccgtgtgttcacaacccctgctaccttaccggagtttaaagcggcgtatgcttgatcacgggtttcgtaagtcttgatcttgatcttagaatcataattttgaagtgacttaatgttgttagaagcaacaacggccgcaactgtctttccctctaaatccttgagcgttttaagcttggaatccttacttacagcaactgcagttggatcgtagctgtaaggagtggtaaatgcatacttttgttgcctctctgtagtaaccgcaacatcattagcaactgcatcaatcttgccgctatccaaggagcctaagagtccgtcaaaatcagcgttcacccatttaaccttgtagccaagccgttttgatgccttgttaacaacctcaacgtcaaacccctttaattttccatttgacttgaaggaactcgggtagctaacaccagtagatccaaacgtcaccgtcttgcttgcagcggaggctttggtttgcaaaattccaactccggcagagattcctaaaacggttaccagtactaactttgttaattttcctaacttactcattttctattcctcatttctttttttcttccctgcgctacatcaactttttcccttatccaccacccttcagcgtaaaacaaaaagggctaccgaccatccatggtcagtagcccttgtacaggttaaggggtgttattagacacccttagcaaaaagagtgtactcaaacagccccaactgaaaccacatcagttcggatgtcattttgagtacacatacacatgacttgtcgtaaacgtaacatgatttcagctcccttcgtttgctaatcttttgtaagaatgatctcatcatacgagccattccgatccctgtcaatagcataattaaatttatctgaatttttgattaaaatcggtgcaccctttctaaccttcccccaaggcctgctggaggtcgacgatcaagtccgccgggtcctctaagccgaccgataaacggagtaaggttggggtgatacccagccgttcccgttgcttttcctcgacgtcggcgtgggtctggtagtacggcagggtgatcaaactttcgaccccgcccaggctttcggcaaaggtgatcaccgaaacgtggttgaggagccgttcgacggtcgcctcatccctcaggtaaaaggagaccatcccgcccttgcccgggtaaaggaccttagtaacggcggagctttgctttaaataagccaccaccgcttgggccccggccgtgtgttggcgcatccggaccccgagcgtcttcaggctgcgtaacaagagccaggagtcaaaggccgccagggtgtcgccggttgtgatgtagtagtcaaagtattcatcggccaagtccttgtccttacagaccagcaccccgcccaggaggtcgttgtgccccgacaggtacttagtcgccgagtgaacgacgatgtcggcgcccagggtgagtgggcgctgatagaccggggtcaaaaaggtgttatccacggcgaccaaaatatcggggcgggtggcgtgaacccggctggcaatcgccgcgatgtcgagctccttcatcgtcgggttagacggcgtttctagccaaattaggcgggtattcggctcaatcatggcaagcaaatcgtcaattcgctccccgttccactgggcgaagttgatcccggcgtgggtcgccaagtaacgaaagtagcggaaatcaccgccgtacaggtcgtctaaagaaatcaactggtcgccggtctttaagatgctcagcgccaactggatcgccgccatccccgagctcagggcaaagccaaactggcccccttctaacttggcgagggtctcttctagcaggcgccggttgggggtcgccagccgcgagtaggagtagccagtcgtcgggtcaaaggccttggcctccgctaggctttcgtggcggtaattagacgaaaagtagagggggaatgaaacggcaccgccccgatcctcatggctccccgcttgggcggcaatggtatcaattgattgcggttgtttggtcatcttcaacacttcctttggtagtcactagttcggcttggtccagcgcctgggcgaggtcttcaatcaggtcggtcacgtcttcgatcccgatcgccaaccggatcagccccggtttaatcccggccgccaactgttcttcggacgttaattcggcgtggctcatcttgctgggcaactcgaccaggctctcgacggccccgaggctaacggcgcgggtgaagaggcgcaggccgttgacgaaggcgaccgggtcgaccgccccgcttagctcaaaggagagcaccgccccggcccccttggcctcctggcgcaattcttcgtaaccctcgtggcccggcaaccccgggtagtacacccgctggacttccggccgggtttccaggaacttcacgacttccaccaggttttcaatttggcggtccaagcggatcccgagtgtcttgatcccgcgggccagttcgttggccccctccggcgacaaaatcccgccgagggcgttttggacgaagtaaacccggtcggctaagcgcggatcgttgacgatcacggccccggccgagagttccgagtgcccggctaagtacttagtcgccgaatggatgaccagatcggcgcccagctctagtggctttaagaggtaggggctcaaaaaggtgttatcgacgatcgtcaggagcccgtgttgcttggcaatcacggccacctggcgtaccgaggtcacctgcaacaaggggttggtaaccggttcaaagtaaattgccttggtgttgtcctggatggcggcctcaatggcttgcgggtcgcgggtgtcgaccgccgtgatttcaagcccccagcgggcgaaaaattggtaaagcaagcggaaggtgccgccgtaaatttggtcacccacgatcaggtgatcgccggccttaaagatcgccaaggcggcgtggatagcggccatcccggaggcaaaggtgaaggcccgctggcccccttccaaggtcgccagttgattttcgaccgcctggcgggtcgggttccccgagcgcgagtaatcgtaggtcaccggcgccccaatttcggggtattcaaaggttgttgccttgtaaatcggcgtggtcacggcgccggtacagttgtcattaacggctggcccgtgcaccagctgggtatcaagtttagtcatggttaattcctccttttgcgggtacaaaaaaaagtccctggatcctcaaaatccagggacgattactcgtggtgccacccttgtttaccgctagattaccctaacggcctctacagcacccaatggatgccagggacagtaacgggtcctaccggaaaagcagccctgcgaccacttttcaacactccgagctcatcttcgcggggttaaccgtccgcctttgcacttacggcggtcactgaaaacggcgctgcccgttactcttctcatcaacgtaaacattagatttaaattaaattgtgattagtataaagaggggcgccccacttgtcaaccaccaataccaacttatttttccctggtcaaactctttaagaccgcgatcgttgtcgcgacctcctctggtgaccatctggtgagacgttggtcaaagaacttgctttcctggcggtgcaactcggcgtgaaggacggccattctttccccggccggcgtcaccgtcagttggtaggccttctggtcgtattccgggtgctccttgaccaagagccctagctcggccagccggttggtgtaacgcgacaccaggctctgggagtacaagacctcggcttgaacttcctggtaggcaatcccccgtttgccagcggcggcaaccaagtcgaggagctctaattcggcgtggttaaagtggttcgaacgtagccgttgccaaaccggctccggcaacacctcccggtagcgctcggccatttcccgttgggccgtcacctgccacttggtatcggcctcgcgcagccggtgtatcaatttgcgaatcgtttggtaatcggtcatcgaaagtccccttaaaatcacttgtaatatatattgacattataacacgttaggtttatatcacgcgtaattaatgtggctaagttgacgaaatgttgttcaggaacgcaattgcagtagctgactttaggttttgacagccaacgaatccctttagaagcaaaatagctggagatcggcgtcttaacaacgtcatctccagctatttttcgatatttagttgagtcacactcacttgataacgtgctcccaaccacgggcctagtatctaagtacggccggagaacggtgccaaggcaccaacccccgccctagcttagccatacggcccgtcgagaaggttggtcgcactcacttacttctcataccaaatcgtcaccggcccatcgttgaccagggccacctgcatatcggcgccgaactgcccggtcgccaccgggatcccggtggcggccagtttttcgttaaagcgctggtagaggggttcggctaaggatggtttggcggcgttggaaaagcccggccggttgccgtgcttaacgtcggcgtacagggtaaactgcgagaccgacaagatagcgccgtcaacgtcctttaagcccaggttcatcttgcctggttcgctctcaaagacccgcaggttggtaatcttgtggaccatgtaatctagcgtctcttcggtgtcatcgggaccaaagccgaccaacagcaagtagccctgaccaatttggccgacgacttgcccttcgatggtgacgcttgcttccttaacccgttgcaatactacacgcataaactcctcctagtgaatgacccgcttgaccacgtacacgtccggcaggttctttaacgaatccatgatcaactggaggtgctggaagttgcgcaccccgacggtcgccgagatggtggccatcttgttgtggtcgatccgaccgttgatcgacgtcaagtagcgggtgttgttgttaatcgcccggatgatgtcattgagcaggccgttgcggttgtagccctcaacttcaatatcggcgttgtagttggtcttgtcgccggctgggttcgcccagtaaacggagacgacccgctggccgctcttttcggccgccttgatgttggggcagtcggcccggtgcaccgagaccccgcggcccttggtgatgtagccgacgatggcgtcgcccggcaccggtgagcaacagtgcgacaggcgggtcaagaggttatcgaccccttcgacgaccaccccttcggaagacttagcgaccttctggcgggtcggcggctcctgttctagggtcttgtgcccttccagaattgccttttgggcggcgttttgcttctcttcttccttgtgcttacggatgtcttcggtaaaccggttccgcaggccgatcggggcgatgtcgccaaagcccagggcggcgtacatgtcgtcggcggtcttgtagtggagcttgccggcgatctcttcttccttatcgctgaccattaactcggctggctcgtagccggcgtccctgagctgttgttccatgatccggcgcccctcgatcacgttttcctcgcggtcgtgggtgcggaagaactggcggatcttgttgcgggcccgccgggtggagaccaggtccatccagtcgcggctcggcccagccgatgacgacgaggttaaaatgtcgacgatgtcaccgtttttgatctcgtagttgagcggtatgatccgaccattgaccttggccccggtggtgtggttcccaatttcggtgtgaatttggtaggccatgtctaacggtccggcgcccttcggcatttcgatggcgtcgcccttcggcgtaaaggcgtaaaccttatcggcgaagacgtcggattggatcccctgcatgaactcgtcggtaccgttagactcgctccgcaactcgaggatttccttgaccacgttgagcttcttggaatcctggctggcttgatcgaccccgttggtcttgccctccttgtaggcccagtgggcggcgaccccgtattcggcaacctcgtgcatttggtgggtccggatctggatttccagcggccggccctcgggcccaatcacggtggtgtgcagggattggtagccgttagcctttggcatggcgatgtagtccttaaaccggcccggcatcggggtccaggaagtgtggatcgcccctaatacggcgtagcaatccttaatcgaatcgacgaccacccggatcgccagcaggtcgtaaatctgggagaactgcttgtgctgggtgaccatcttgcggtagacagagtagatgtgcttggggcgcccgtagatttcaacgttggggccgaggtcgaggtcggcgatcgccgttttcacgaccttgatagcggcgctgatgtagtcaatccgctggtcgcgccgggagttcatcaagtggacgatccggtagtactgttgcgggtttaagtagcgcaacgataggtcttctagctcccatttgatggtcgaaatccccagccggtcggcaatcggggcgtagatttccagcgtttcgttggagatgcgccgttgcttatccgggcgcaagtgctttaaggtccgcatgttgtgcaggcggtcggccaacttgacgatcatcacccggatgtccttgctcatggcgagcaacaacttccggtgggtttcggccatctgttccttgttggacttgtagtggatcttggagatcttggtgtcgccgtcgacgatcatggcaatcgtcggcccgaacagttccttgatgtcatccaaagtggcgccggtatcctccaccaaatcatgcatgtagccggcacacaccgtttccgggtccatctttaattcggccaggattccggcgacttggattggatgaatgatgtagggttcaccggacttgcgaacctggccctggtgggcaacggctgcgaagtggtaggcccgctccactagggccacgtgctcctcattcatgtacttggcaaccatgtttttgacgtcttcgtgcgttaattcctttgtctgcgacatcaagccaccccccttttacttgttccgattagctcgcagcattgaccacgctaggtaggccaccgccaggtacgccggtgcaaaatacaggctgtacttgggtccaaacaggtgggccgccagcagaaaactgaccgggaagacaaaggcttgccaacaccggcgccggttttgaagggtgaacccagtccaaattgcaaaggccccgtacaagagcaggtagaaaacggcgaagcgctccaccttgttgataaacggtacgatgttaactaaccaggtcacgacaaacccgatcaagatgctcaggacccacaaacgacggtcggcccgctgccataaactcttcaaactcttcatcccttacgattgattattagtattcttattttagcacaaaccacggttggatttagcggctaatgttcggctaattcaaaatggtaggaaacggccgccattaaatagagcggcgccgtttcggtccgtaagattcgcggccccaagccgcaggccaccacgcccgcagccgtcatcgtttcgacctcggtttcggtcaagccgccctcgggaccaaagatggccaacaggctttgccccggcgtcacctggtcaaagacggttgccagggccgcccgttcgccctgcttagccgactcttcccaggcgaccactcggtgatcgaacgaaaagacagttaacaaacttttaaggtccttgacgtaggatacttcgggaatctggttgcggtgcgactgttcggccgccgcgttggcgatcttttgcaggcgctcgaccttcttgccctggcgctggtcgttccagtggctcaccgagcgggcactttcaaagaagatgatccgcttggcgcccagctcggtcgccttttgcacgatcagttccggcttttccttggtcttgggtagaccacaggcgagtgtcacttcgatcggtagttcgctgtcgccgccgaggtcttgttcgaccttgacttcggccgtcgccgggtccaagagggtcgctaagtaggcgtggtggtcggccaaaaccagttcgacttgggtgccggccgcggcccgcatcaccgtaatcaggtggtggctcacgtcgtcagggaggttcaagcggcggtgggccggcagtgcttggtcaacaaagtagcgttgcattaggcttcctccggtgctggcttgtgggcgatgatcccgtaccaatccttgatccgcatcgtttcgtcaaccacaaagccctgcgcttcgatggctttcttgaccgtttcaaacttggtgttgataatcccggaggtcaagaacttgccgcccggcttgaggttctcaaaggcttgtggcactaatggcaggatgatttcggccaggatgttggcgaccaccagatcgacctgggtgtgaatgccgtccaacagtgagttaacccctgtgtgaacgtctttagcgatcgggttgagcgctagattttttttggccgacttaacggccacgtcatcgatgtcgtaggcccagacctcgccggcgcccagttgcttcgccgcaatcgacaagaccccggagccggttccgacgtcgatcatcgattcaccgccacgtagggcgatcgttaacgcttggagcatcagctgggtggtcgggtgggtcccggtcccaaaggccattcccgggtccaagacgagcagcttttcatcggccgtcgccggggtgtattcctcccactgcggtacgatcgtcagctcacgggtgacgcggaccgggtggtagtacttttgccaggccgtcgcccagtcctggttatcgatttcttcggcagcgaccctggccggggccgggttgaggccgaagtcggctaacttggccacccgctggcggatgtcggcgattttttcgggcacgaaggtcgtgggcgggtagtagccggtcacggccgccccttcctcgcggtgtggtaaggtgctcgggtcgacaatttcgccgtagggcccgtacttaccgggcttgagcttttggtagtcggccgcgtcgtcgatcttgaccccggtcgccccggtgtcggtcaaaatgtaggaaaccgcgtcgacggcttcggtgctggtttccaccacaatggctgtccaattcatattattgattcattccttcctgaaagaaagggcgcccccgcggacgccccttttcttattcttcttcgccggtgtgaacccgcgtcgcctctttggcttcccgcttttctaagtggtgggccaggtaggccaacatgtcatcttcggtcttgaagatccgcgggtggtgttggtgatgcatccggacgtcgatttcgttaatctttacccgccccgtccaggtgtgggagtagcgaatgattacccgattgttgagccggtgcttgccgaaccggaaaacgtaaacgtgctccggcgacatcatcggccggatgtattctttcttataagtaagatcgtgttcgcgcatgaattgcttggtgcgatttagcatggtaatcacctccttatcatcggacccgtcgtgggctttttcgtctttaatggacctattttaacacacagcgccctgcttgccaaaggtctaggcaagggattaagaaatctcaagttttttaatggagtggccaatcacctccccagcaagtcggctgtacttaggcactaggcctgcggtgattgaccacgtttgctgtctaacattcgcccacctaacttccctaaggattggttaagttcaccccttcttcaaattcgccgtgctataatcggtgaccaactttaaaaggaggagttcaaaaatgggcctaattatcctgctaatctgtttatggattatgtggaaactattgaagatgtccttttggttattggggcttttgatcactattgcactgatcatcttcgccgttaaaatccttattattcccggtctgatcctaatctgcctaatttttgcgggaagttttttcacaaattagccatttattgagcaaacatgctataatggcaagcgaccgataatttatcgtggttaagagatttttaaggagtgaattactgtgtctaagactcatcaaaaagttgttttaatcggtgacggagccgttggttctagttacgcttttgccatggttcaacaagggttggcccaagaatttgccatcattgacttgaacaagaagcgcacggaaggggacgccctcgacctcgaagacgctaccccgttcacggccccaaagctggtttacggcgccgattacgacacgtgcaaggacgccgacctggttgtgatcacggccggtgccccacaaaagccgggtgaaacccgtctggacctcgttgacaagaacttgaagatcatcaagtccgttgttgaaccggttgttaagtctggtttccaagggatcttcttagtcgctgctaacccagttgacatcttaacttacgccgtacaaaagttctccggcttcccacgcaacaaggtggttggttccgggacttccctggactccgctcgtctgcgggttggtttgtccaagctgttcaacgttagcccggttgacgtgaacgccaacatgatggctgaacacggtgacacggaatttgccgccttctcctctgcaacgatcggtggtttaccactgtacgatctggcagaagccaagggcatttccaaggacgacctttacaagttggaagacgatgttcgtaacaaggcttacgccatcatcaactccaagggtgcgaccttctacggtgtggccactgccctgatgcggatttcccgtgccatcctgcgcgacgaaaacgctgtcttgccagttggtgccccaatgagtggcgaatacggcttaaaggacatctacattggtaccccggccgtgatcaacgctaacgggatcgccgaagtcctcgaagttccgctggacgaacgcgaagccaaggcgatggccgactccgctaagaccctggaagaaatcgctaagaacgggatggctaagatccaaggttaaagccagagtgtgaaataacctccttggcaggttgtatgcttgcggttatttcacaggtttcctgtctaacatttaaaaaaagcaacgcccacactttcctcgttggaagtgtgggcgttgcttttttattatgacttaagccttatatcccgtgactttagtcatgggatataaggctctttacgaacgctcgttggcgttctttttagtttaactactttaatcatcgcgatataatatagacacaattaaagaaaaggaggtggatacaatgcaacaaacgctaactgctaagattcgactatatccaacgcatgaacaaatagcgctatttaaggcggtgactaaggaatatcaacgcctgtgcaatattgtcagtcaatggtatttcgatggatattttaatgccaatcaaaaggtctttcagaaagacatgtaccattatctgcgaaatgagtcgccaaagctcaactctcaaatggtacagtcaacctatagaacagttaaggcacgatatgacacggtaaggacacaattgtatcagcacccttatcgttacgataccggactcattgacgaaaagaccggtaagcatatttgggaatccattccccgaactttagagtggttatggaagccgattcactttaaacgccctcaggcagattatgttcatggctctaactattccttcgttaaggaacgtacgatgatctcgcttaacgttttgggcaagcgaatcaaagtaccgtttaaagcggattatctggaagatttgttcgctaccaatgccaaattaggaactgctaaactagttcaactaaaaaaacactggttcttacatgttccggttacgattgaagttaacgaatggaaaaaaatttgcaatcagcacattgtgggtatcgaccgtggcttgcgtcagattatgacgatctatgatgaacaagggagaactaagtttttcaatggtaaacgggtggcctatcagcgtaagaagtacgcccatttgcgcaaacaactgcaagctgccggtaccaaatcagccaagcgtcatctaaaacgactggctggacgagagaaccgctggatggaagatgttaaccatcgcctgtctaagacactcgtacagcactatggagaaaataccctattcgttttggaagtcttgaccaacgtatcgtttgatgaaaagaatcaaagcactcgtgatcgtaaccgcgacctgcattcttggtcgttctacgaccttcaagttaagctgacgtacaaggcacaagctaagcaatcacaagtattgatggtatccgctaaatacaccagtcaacgttgccctaaatgcggtcagattcgtaaagaaaatcgtaatcatgcactgcatcgctacgactgtgcatactgtggctttcgaactaatgatgatcgcgttggcgcaatgaacctttacgaactcggcaaacaatatcttgccggaaacgagcgtccaaagtttgaattaaacaacgttgccgactgatacgttggcaatcaagggtgttgtcaatcacccaaacgtagccacatcgtgaagaagcacattagtgcgttactacttctaagccgttaggcttgtgagttacaagccaccgattttaatcggtggtaattgacctaaaactgtgcaaatactccggctgcgggtgcaagaaggtgcccgccgtaaagccacagtagttgatgatttggatgatcgccagtggccagaggtcgatcgccgcgtcggcgttaagcaagtagcgcaggtaaagcacggtgctgatcccgatcgaaaccagggcaacgccgatcatccggcggtccaataaggcgacgagggctagcatcaccatcacgaagtaggagtaacggtcgtgcatcgacggcaagaacatcgtgcgggtccaaaagctccaggtcgccaccaccaagaaacgttgcggggtcaagtccaggcggcgcagataccaaaagccggccaagagaatcaggcaggtcaaaaccattagcccccgcttgagcagttcgtagtggtcgaggaccgccgtcggaaaggccagttgcaagaacttggggaagttggcgatgtttaaggccaactctttgtaatcactggtttggccggcgtagatggtcaacggcgtcaggaggctgcggccggccaagaaacccggtaggttcatggcgtacacggtcaccgggacccaaccgaactggtaccagtggcggtagtcgtgccgggcccagtagacgtagttaaaccgcagcaccctgacgtttggcaaaatccccaaaatagagacacgacaaatctaaaatttggcgcaatggccaattacccatcctcaacaaaccacgttagcactggggttctaggctaccgcccccattctttgcgcaaatctaaaaatttgtcgggtgtcgtttcctgggtaccggcaaaattaaacacggtagatccttttgaatgcattttccaccactttagcgcatactaaacgtaccctaaaaagcgaggaggcagaccatgaaactgaaagtccaacaggttggcgactcattggcgttcgtcattccaaaggagtttggcatccctgacggtcaatgttacacggtagaacagaccgctgacggtacgatcattttccgccccattcccccttccctctttaaggagaatggttttcaaggaaacgaactacgccaaaaggatgttagtttggaagacggggtgctagatagcgagtggagcgactagcaatccgaatggtaattccaacttcaactcaagccaccttttcaatagatactaagacgaaagcgcccagattacgtaatgcaatctgggcgcttggtgtttacatacggaaggtttgcgcttcctagttttccacccagtacttggtctgggccttgaagaattcggtgcgtaaaaagtcgtgggccactttcgtaacgtcggcgtgcggggccacttggtcaaagccatggtagcaaccatcaaagaccttgcaagcaacggggatcccggcgcgttcgaggcgcttagcgtacaaacaggtttcatctaaaaaggggtcgaggtcgccaacgtaagtaatcgccggcggcaggcccgccaagtcagtggcccggccgggggcggcgtaaattggaatcttgtcgagcagcaagtcgcctaagtagaggtcccaggctgcctgattaacccgggagttccacaccggagcattgttattcttggccgaagctaacaccagccggtcgtcgagcatcggatagattgggatttaccagtcaatcttaacgtccccttggtcgcgggcccataggcagacggccgccgttaagcccccacccaccgaatcgccgccgaccaccaactggttggggttaaccccgaacctcgtggcgttatcccttagccacgtcaaggctaggtaacagtcgtctagggccgccggatacggtgccaacgccgaggtggtgtaatccggcgccaccatcacggaccgtccgtcagccaccaactgttcagcataaaccaaggcattttcggcggtttccaaggcgtagcctcccccgtgcaaccagaggatcccggtggccgggcgcttggtagcaacttgcttggcccggaaaatagccagccgaagcttgctatggtcagggcgttcaatccaaacgtcttgtttgatcacccgccgcgagtgaatgggcatttcgccttcgccgttattcgtcccattcgttgcaggcgtgcgggctggccatcaggttgatcgcgtaccccaccttgccgatccggtgcagttcggggcgaatccgttcgggatcaatttgcatggtaaacacttccgatcattttggccctatcctagcacatcgcccgctaaagttcccgtcagattaccaacgtgaaaacatttacctttccctcatcacttctaaaaaaggcattgctaaaaacagcaacgcccttagtctataattctaagactactgatctgacactcatccaagaccggttatcccggtcgccggtttttccggtcgtactcggaactactgatctgacactcatccaagaccaatggccacggtgatgatattttgtcggcgtactcggaactactgatctgacactcatccaagaccgacgatctacacaaggccggacttaacgtgtactcggaactactgatctgacactcatccaagacagtcttcgtcattagcaatgttcttcttttgtactcggaactactgatctgacactcatccaagaccggggatgggcaaggtgctacgactgccaagtactcggaactactgatctgacactcatccaagacgtcgctaggcctatctaaccaggacttcctgtactcggaactactgatctgacactcatccaagactgccccggtagtaaatgttctgggtggttggtactcggaactactgatctgacactcatccaagactgttgtgcaatcccttgtgtagtctagggtgtactcggaactactgatctgacactcatccaagactaccgatagtcatcaactggtattattcaagtactcggaactactgatctgacactcatccaagaccaagcaagtaaacgatcaggatgttatggagtactcggaactactgatctgacactcatccaagactgatcgggtcatcgtctggtaactcttgcagtactcggaactactgatctgacactcatccaagacttgtgaaggcctgaggtattcccacgatgagtactcggaactactgatctgacactcatccaagactgcaagcgttgtgttgcctacaagcgccttgtactcggaactactgatctgacactcatccaagaccgtgtgcacctttgtagcctggctcattaagtactcggaactactgatctgacactcatccaagaccagcaagggctttgcaactaccaacacagtgtactcggaactactgatctgacactcatccaagactcgtatcgtcttcataatctcctccgttgagtactcggaactactgatctgacactcatccaagactagcttgatgaacgtaactctggattctaagtactcggaactactgatctgacactcatccaagacggttgtctatattcaacaactcttgggggtgtactcggaactactgatctgacactcatccaagacatagctgagtgatcttgctcgatccgtcaggtactcggaactactgatctgacactcatccaagactggactggcaagcctgtttaaggacaaggagtactcggaactactgatctgacactcatccaagacgtaattatagtcacgatggatatcgtcaatgtactcggaactactgatctgacactcatccaagacgttggcaaagtcccttatgtatggggtggagtactcggaactactgatctgacactcatccaagactaaccagaccgtcaatgtctacccgctttagtactcggaactactgatctgacactcatccaagaccaatcactgccgctataagcaccgctaagagtactcggaactactgatctgacactcatccaagacggaggaggcgtccgaattcacgggcgacgagtactcggaactactgatctgacactcatccaagactagatagttagtcttataatgctgtaatcggtactcggaactactgatctgacactcatccaagactgttttgctgttaatttcatggcatctcacgtactcggaactactgatctgacactcatccaagaccccgtggttggcgaatgtagacaaaatcttgtactcggaactactgatctgacactcatccaagacgaatattcaacgccaactgggtaacagtaagtactcggaactactgatctgacactcatccaagactaaggacaacgtgttcgtgctaggacaaaagtactcggaactactgatctgacactcatccaagacttcaatgttatctgcgtcaaggaaccggttgtactcggaactactgatctgacactcatccaagaccgttattttctcatcaaaaactaacgatctattcgtgccagtccacgaagtcccgatcaatccggtaaatatcctgtttgagttgttgtagagtttctctcttttctgagaattccactaataaaactgccaattcggttttctcaacaagagtagcgaattcctgtatctgctcaggcaataagtaattagcgacattacaatacccaagaacctgacagtcttttaattcgagatgtaattttagatcggtttcaattataccataaggttgccttattacttgcgtcaaatatttaattttcgcatatttgtataatctcaagaggctctcgtcataccgcacctccaacggtaagtcgaattcgaacaaagaatcttgcatctctgagaacacctcacgagcaaggtcattcatccgatctcgtttctgaatgctaagatttttgacaatcatcttatcaagtgctgtttggtagctatcaagcttggttggattaagaacaaggtctccttcccacttcattaccttactcaaattaagctcttggtactcatcgtcaatcatccttaagcaatcattatatccctgcaacccctgaattaattcggtgttgacgcttgggttctctatttgcaaaatcactacttttccaggcatcagttcaactggttgatggccatggtattgcaatttcatagtacaatcgtcctctttgatgaatttctaacttctttaacctcatcaccaagcaagaaatgcatgtcactgtattgcttttccgttaacattaacgattggatgactccttggtctggtaaataatccttaagccttctctccaaaaactcagccgcactccttgtcgtacatacacgaacgtaaacagagtactggatcataataaatccttcatttaatagcttcttgcggaactgacgatactgctttcgttgctgactagtgtccgtgggcaaatcaaacatgaccatcaagcgcatgattcggtacctcatctttaaactccacctttacttcaatttcatcccgctcaccactcaagtaatcaagacattcccgcacatactgcctcactgcattttgagtcagcatttcaatcccgttatacttgatcaccgtatgcattgcatctactaagccaactcggacttgacgattgaattccgtaaacttttgtcctgtaacccagtagtcgatcactggtcgaaatggttccatcaaatctgaacccaaattaaacctgttttctcgattttgatgatggattcctagttccatcagatagccattttccgtaatcgattggtttgtctccgctaataaaaccgcatatccataatccagagcggcgttgtattgattctcctgtcgtcggctaaaatcttttccgaacagcaatgggaaatactttcgagcaaccacagcctcacggttagaaatatcatttacttcaatggcttctaactcactttctagttcttgaaccgggcatccattaagccgggccacctttatttggctctcgattttggcgtgggcaatcctagtccaaagttgttcccttcgctccaagggccataagaattggcgttccaacaattcataatccctcgctactggctgataaccaaccgtctccccaatcggttggtactttcgatcgacaaagattactttaatgttccgttgtaggcatgcactcatgaaatctgaagagatcatcgcctgagttgtttcaactagtacttttgcaatgtcatccatcggaatttcattaatcccatctttagtctgcacaaccatcatatgagcagagtgggtaatctttgcatgttgaccaatgattattgaacgccatcccatttttaaaattcctccttgtcaaattcaaccgaattccatataatataacttgtcgggtagctcccgacattcgagactactgatctaacactcatagtcaagatcaaacgagtggttttccacgagttattacttttgagccatgttattctggccatacatataataaaaaggagtcgatttaatcggctcctttttactttactcttaaatgtctttcaaacaaatgcgacgttcaaacaaaccggttggtgactggtatacgatcattgcatcttcacttaaattcagtccacctgaactctggaaaaacccaaaggttgataatcctaatactttcaaatcaccttgtgcagcattggcatgtagacccatcagtaagttcgtaatgacttctgtcttccctacttgcgttttcttagcaccctcatactctgattccgttggtaacgatacaaacttatctcgagccttcgttaccttttgacgattactacgttggtcaaagatagtaaagtaatggttcatttgattaacaatttcatcaaaaaccctaacaagttgttcatccgcagttgccggattttctttcacaaatttaaaatcatctgcaattatttccatcgattctttagaaagaactagctgagttgccggatgctgataagtatcactagctagggtaaatttgcagtcaccatcaactatcaactgactatacgaaacatgtggaactacaatctcaaaatctttctttaccttcggattagatttaatgattcgatgtaattcttggttatatgattcactgcccggtttcccaactcgttttaaaccgaccgccgatgttgttggaaccccaatcaccttatacttaggtttgtttccagtaaacttaatgatcgtcatgaaagctgacgttccattcgtataagcaccatacaaatcaacaggtcgatttttcttgatctcaattggtgaagtgagcttaccagattcctttgctgttacaatcgttgctccatacagttggtcactccggtcgtgaacttccttcgataccagcatatacttcatgttcaataatcgatcaaagctcttggctacttcatcccttgtcgtaatcagttcaccagtttgttgatcgacaaccttaccttgactcttatcgccttccatcaattcatggaagaagttaaagttacgtagcttcagatctgacccatgcttgaacttcatgtactcaccgtatacgaagaaggagcgtaatttcggataacggcggttcaaatattgcccagcaaacgtcgtcaggtaagcatcaactgcgtggtgatagtcgtttacttcacggacctttggtaaatcgaattcctcgcgtaattgcttagttaaaccagcccgagtctcaatgatgtccgtcccggcttcttggtacatactacccaagatgttagccgtcaacttgataacttggcgtgtttcaactaattggcgcttcacgaatccaagtgaccgatacttaatattttgatcaacgtccatcgtcaggttttcaaacttccgttgcgtgatcaatccctgcttcaaaagttggttccagtatggtttcatcttggctgcgtaaagcttagctggaacccggtcagacttcttattattctccgcccgacttactaacacccgattatctaaggaatcatccttcacgaaggattgtggcaaaatgtggtcaatatcatacttggtagaaatttcatcgaagttgattggatcaccggtgtacatatccttaccaccttgggtgaagtagaggtaataacgatcggaaagatccggtgccttctccaattcctcagtcaagctcgtatccttaactaattcatgggcctgatctttaaataatttctgcaattgagtacgccggctccgggttatttctcccttgttgccttcattacgggcaaattcgattgaaatcgactttggtgcattcccgaccgctttaacaatatcttccaccacccgaacaacttgccagatggccttcttgttctgcggtgaagtataggcgtcatccagaacgctctcgacccgctcccgcaaagtcatcccatcattggtgatggccttttggttcagttggtcaatctgttctttaaagacgggctggttgacaatctgcatgaagttttgatcagtattccacatcagatcaatgatccgttggccgttctcgtcaacgattcccgtcagtagcttcttggataaacgtccccagcccttataccgtttcttaacaagggcagaacgttgctcatccgtcagccattccacttcagttaacttgtccgcaaaaatttccccatcttcaaagacggaacgccactcgataatgttttcgaggtccgtttgataacggttatcatcaaccttgtcacccacaattgactttagatcaaggtaggttgccaaatttgaattgaacttcttcggatcggataaaccttcaacacttggcttgttaactcctcgtgtcttcgccatcactaggctggccacgtcacctgccttcaccgtctttttcttcttgaagagctcagtgtaaatatcttgtttaattccgactgataggcggcgtccattcactcgaacgttgtttagttcgtttaagacgttgtacttttggtatagcaagctgttagcaggcaggacatcctcgtttaatagatacgtatccttaaccgtcatccgcttgataaaggcttcagctgattcagcacggtcaatcttatcccacaggttccaaggggtaatctccccatcttctttccgctttgcccaagcaaacttagcgccagatgtcgccttttgaacctcaggcgttactagcggtccaacatagtaaggaatccggaaggaaactagctgatcaagttcatacttcgcttggtgacgatcacgttcaccagtggctgggttttccgttgctagccacgggtagtacttagcttgcttttcaataatccggtccaattcttgttggtgcatctggtgtgggatgaccccattggctgatgtccgttgctttggtaagaaatcacctgccttgagtaactcatcgatttctttccaattttcctttttggataaaatcttcttgagtcccttttcaaggtcaaagcccttttcctttggcacttgcccaatgtatttgttatacacttggtcaaactctttccgcgcgctagctggttgggtcgccaagtattccttaacttccgctaattgacgttcgtgcgtccaataacgatccatcatcgattcagaaatcgacatcccatttggcacgattgcattcagcatgatctgcgagaacaggctagtgatttccgttaagatatcattttgagcatcactcaattcttcccggaatttttcaatctcgtcctcactagtttcagaacttaaatcgatcttccattcgttgccattcgccatcgctaccgttgcaaagtccgccttgtagccaagaactaacttactcatcgccgttgcaatttgcttgttgcgcttggtctcctctttgtcagcgaccttcacctctaacaatttggcgaccgctttttggcggtccaacttacgcatcttcgtatctagcaacagttgtccaattttttcaaccttgttaggctcaatcgtgaatgaaccttcgccgttttgaagctcctcgtaggcttcgttcaaaacgttaaaggatttgtcaaaatcgattctccccactttgaacttatcaacgctagcgttatttaagaagtgaccccggtacttcacgatgtggtgaacggccaggtaaacttcccgcagatcaaattggcgatcttcgttaatcatggcttcccgtaacttgtagatgttcgttactgggtagtgggcgcgttgctcaactggcaattcatcgcgcatcttaatcagtgttgggtaaccacgctcattcttcttcagtagatccggaaataagagcttaccaatgaaggcttgattcttcgctggatcttccgggtggatatttgattgcttcagacggcgtaagaaattttcatccacttcttgtaagtgcggggcaaaaattttatctaagtagtgcaagcgccattttcgccgcttcaaccgccgccgcgttgtccggaaggttcgacgttctgcagccgtcttcccttcttcaaacaaccgcaccccgattgccgtcttccccttgatacgcatcagtttaaattggctatccgttaccgcccagccaattgagcttgtcccaatgtccaagccaatgtgatactctttcacgtaatccactccttaatatcgtagtcaagatagattatagcaaacgcaatcgctttcagtagttattttgataaatttgaacgaaggatcagcgactatttcgcgacctctttttgcgtttgccgactaactccatagtatcccacccctcggacatattctgtcgcccgcccaaaaatccctcctaattccaaattttctcctcttcccacccaaaaaccccagccctcggtttcccgaacggctggggttttctaattctatttaattggcggagcgaacgtcacggaaccagtagatcaatgacgtgtcccagtggaccgttccctggttgtccatcgggtacggcgccatccggtagtacgggacgtgggcgatgtcaacatcttggtccacggcggtttggttcttgatcacgaactggtaggtaccggctggcacgttcccttggtaatcgtactcgtcggcgtggcgcttgaagacgtattcgtcaccagtttttagttctaccagggtcaccgtaacgtgtgacttggcgtggatctgcacggagacgtcactggctgccccgttgatcttgacgacctggctgatttgcttgcccggcgccaggtcaaccggcttggccccgtactgggtcgatagctgggagcgttgggcggccaccgtaacggtttggccgctggagttaacgccgaggttggtcatcgccccgaccaggaccgccaccgtgccgagggcaaagacggacccgacttgcttaggcgtgatcggttggtcgtcagcggccggcaggagggtcaccaacagccagctcagtggcaccagcacctcgccgtagcgctcttcgacttcccacagcaagacgtggaaggccaaatagcccagcgccgttagaatcaccagcagggcaacttgttcgttggccgaggccagggtcatcttggtcgccaagagccgcttgatcacgaagccaaacaacaggcaggtcgccagttggtaggaaattgccacgagcccggtgaagaccggggcggccttgaggtagctccgcggtgcctcttgcatcccgccgttgtaccagtggaagatgttgccggcgttggttagcaccatcagcttggctagccagagcttgattaaaccgacgttttgcttggccaggcgctgtttaatcacctggaggttgtgggcgttgcgggccgccttggtcttgagcttgacgttggccacggcgtccttggtgttgtagaccccgttgctcttctcgttaagccccatcgccacccactgggtcagcgggaactcgtagtcggtctggcgggtgaagtgggccgccttgtccagggtgctggagagcggaaaggacagggcgacgccgagcgtaattaagagcattggcactagtagttggctttgtttaaagcggtggcgcccccataaaatcagggcggtcaacagcatcgccgggataatcacgatcatgttggccttggttaactgacccagcatggccaggagcaccaagagggccccactaaggctcttttgccaccaattacggcgccgccacaagaccagcgtccgcaacaaatacaagaggacgaacatcaccggcaggtcggtgtaaaagacctgcaggtagtaggtgtaggcaaagggggtcaggaccccgaaggctaagatgcccaagacgaggtgctttttcttgctgacccgccaggcggtgtcgatgccgagcaggaccatcccgtccagcatcagcatcgacaagaggtggacgccgcggttgacgcccatccccatttccatcgtcagcttgagccagcgcgacaggaggtaggcgatcggcacattttgcgggtagcgccagaagtaggtaatcttccagctggtgtggccgaccgccatccgggtcgcctggtcgaggacccggagcgggtcgtggtaaaccgtcactggcaaccactttaagaccgccatctgcaagagcaccattaccgtcatgccgaccccaacgagcagggtgacttggcggttggtcaaccggtcaattacgggggctagcttaggcaggccccaccagcccagtagggttagcggcaccaagattagggaggtgacccagttttgcgagaaggtaaagttagacaccaggccccccaccaggcaggcaaccaggatccaggccagcccgcggctcactcgccgggccccggtcaccgttcccaccccggtttcgtcatcaatcgcttgtgcattttatcaactccactttcaattttcagcaatattataagggtgcagcgcatgctttgaccataaataattataacttagttcaaagttaagaatgcactatgttttctgactgatccccgctataatggaggggtaatagttgctaggggtgtcggaccaccgactgagacgccaattggcggaccctttgaacctgggagtttggactcgcggagggaagcaacggtcggcgaaatgggccaccgggattccccccggtggccttttcttttgtcgctaacgtgctcaccaaccgcaggcctagtgtctaagtacgggcaaagaacaccgccaaggcgctaaccattttccctagcttagtcatacggcctgctaaattggttggtgaccactcacttaaattaaggagaaaaacatgcaaaacgcaatcgcaaccatcaagggaaccaacccgatcgtcttgaccatcgccaataacgttacccccgccaacgtcgccaacggcctcaacgccctgggcgcctcgccgatgatgtcgcaaacgccggaggaagccgacgacatggtcaacatcgcccaagccgccgccatcaacctggggacgctcaacccccaccagcgcggcgaaatggaggcggtaatggaagcggccaagaagtaccacaagccgaccgtcttggacccggtcgcttgcggcgccaccatgtaccggctccgggtggtcaccgaactgctccaccagtaccacttcaccgtcatccgcggcaacgccggtgaaatcgccaccttagccggggtcgaatggcaaagccacgggattgacgccggcgagggcaacgccgacctcgagaaggtggcccggctggcggccaaaaagctcggctcggtgatcgtcttatccggcgaagtcgacatcgtcactgacggcacccgcctggcccgcttgccgtacggttccccggcctttaagacccacgttgggaccggcgacatgctttcgagtttgatcggcgccttcttggccactaacgacgacgcctttgacgcggccgttgacgccgtgaccaccttcaccctctgcggccaagccgtcgaagaccagcgaccgggcaactggtacccgggactgttaaacaacctcgacgccgtcaccgatcagcagctcgccgcttggcaagaagcatttggaaaggaagcttaagatgactaacgaatttccccaggccctgacgatcgctggctccgattccgggggcggcgccggcatgcaagccgacctaaagacgattcagatgcgccacgtcttcgcgacgacggtggtggtggcggtgaccgcccaaaataccctcggtgtccaggacgccctcgctttgccgactgaaatgatcgacgcccagttcgcctctttggctgacgacttcaagattcgggcggctaaaacgggcatgctggccgacgtacccaccgttcaggcggtcgtgcgcaacttaaagcagtacgactttggccccctgaccgtcgacccggtcatgatagctaagggcggcgccaggctattgaccgacgaggcgattaccaccgtcaaagaggagctcttgccgctggcgaccttggtcacccccaacctgccagaagccgaagccctaaccgggttaaaggcggagcgccccgctgatatggttaaaatcggccaggccctgcaaaagctgggtcccaaaaacgtcctggtcaagggtggccacctcggcggcgaccaagcggccagcgacttcgtcttgatggaggacggcaccagcttttggatgacctcgccacggatcgacaccgttcgaactcacgggaccggcgacacgatttcggcctgcatcacagccgaactagccaagggcgtcgggttagaacaggcgatccggaccgctaaaggttacgtagaagcgacgattcgcgacacgatccaggttggccacggccacggcccactgaatcactgggcattatagagagtggcaaataacctaaccagcaggccgtatgactaagctagaccggaggttggtgcgcttacgcaccgttctgcggtcgtacttaggcactagggctgcggttatttgccacgttttctgtctaacatttgaaaactagccaatagctagggagaaaagccatgttatttaaaaatggaatgctgcgctgctacctgatcggcggcagccaagacacccaccacgacccggatgagtttttgaccaaggtcgaagcagcgatgcaagccgggatcaccgcctttcagtaccgcgaaaaagggaccagcaccctttcaaaggcggaaaccctggcgctgggtcagcaagtccgggagctggcgaccaagtacggcgtgccgctctttgtcgacgacgacctagagctggcggccgccatcaaggcagacggcatccacgtcggccaaaaggaccagcggatcgaagaggtcttagccgcggtcggtgaccagctaatggtcggctactcctgcaacacggcggcccaagtcgcccacgccaaccagctgaacgtcgattacatcggcaccggcccggtcttcccgacgatttctaaggacgacgccggcagcgccctgggtgtggacggtctcgccgacttcgttgaacaatccgcccacccggtcgtcgcgatcggcggcattagcctggacaacgtcggcgccactttgaccagtggctgcgccgggttgtcgatgatctcgatggtactgggggcagatgacgtcgccggcaccgtgaagaagattttggaactgtattaaacagcaaaaggctcccggccgttctggtgaacgactgggagcctttattcattagctttggttagttggccgcttcttgaccggcccagtggttgatcgggccaaactggtggccgacctcaatttcgttggcgatcgcctcgtggacgaccttcttggccaggcgcaccccggcttcaaccgagtgtcccttggccagttcggcggcgataatcgccgagaaggtgtcgccggtcccgttgacccggtcggtgggtacgtactcttcttccagccagaaggtcttgccgtccgctagtgacacgaagtcgcggaccggggtcgtttgcccctcgatgtgttggcccttaatgacgacgttcttggcgcccagggcgtggagcttggcggccgcttcttggacctgatcgtcatcctttaattccaactcggtcagcttttgggcctcgtagaagttgggcgtgatgacggtggccagcgggataatccgctcgcggaagagctcgtaggccgattgttccaggagcatcaccccgtgcttggtaatgatgaccgggtcgaccaccagcgggccgaacttagcttcgtcataagaatcggcgacggcgttgatcacgtcatcgttggctaacatcccggtcttggccgccttgatggcaaagtcgtcggcgaggaccttaaactgttccttaatgaagctggtcggcatgatttgttgctgggtgatcccgtaggaattccccgacacggcggcggtcagcagcccctggccgtaaaccccgtcgataaagaatgcgtgtaggtcggccggcatcccggcactgccgtcggaatcgtgcccggcgatggttaaagcttgaacgtattgtgtcatattaagcctccggatcaaattctcttctcaaaattctcgtctggatcgtggataaagcggcggtaaatcgccagtcccaccgtcagcaagacgatcgcccccacttcgaccatcgtttcgatgccgttggagttgctagcggccaagaggtgccgcaagagggcggttaaccccagccccatcagcatcgtaattgagatgtggccgtggttgcgcagggcttcgatcaccatcacgatgaactcgaagatgatgaaaaaggaggtcacttcgttcaagaagtcgtaaaagccggggtcggaaaccggggcgagcgccaacttgatgaccgccaacaattccatccccagttggacgatcaacgccaaccccaggagcccgacggccactaacgctaccagttcgagcaagtgggcaatcttttgaaaccattcttgacttgacacctcaatcaccattcctttctagtggctacattataacattgaaccggaacgaaaatggatcatttcccgctttctgttcgtttttcttccgggcgctttttttatgaaaacggtgtctcacccttctttttaagcaataaccgatcggcaaaccacagccagagcaaactgatcacaaacagcggcaagaagatcaatagcaaggacccccagttagtggccgcggagcccccggtcgcaatcgtcggctgaaagtcgatcaaggagtgaagcaagatcccgacccataacccgttggtcagaatgcgaatgaaggataaggcgagccctaagataagggcgtaaaagacttgttgcatggtggcgtcgacgctttggaaggttaagttcgataggtgtaagagccccaaaaacagcccaccagtcgtcatccgaatagcgggctgctttttattttctagatattgaacttacataccacccgtcgagaaggttggtcgcactcacccataacgtactccccagccgtaggcctagtggctaagtctggccacagaacaccgtcgagggcgctaacccgtgctctatccttaccccacagcctgctttatggttgggtcgcactcactttttccaattatcctcaataaactgcttacgcccaccagccttctctagcttcatccgttccgggtccttcttgtaaaagtcctggtggtaattctcgaccacgtagaagggctttgcgtcttcaatcgtggtcacgatcgggtcagtgaagcggccgctgttggctagggcatccttggaggcctgggcgatggcgcgctgttcttcatccttgacgaagatcaccggccggtagttatcgccgcggtcttggaactggccaaaggcgtcggtcgggtcggtttgttgccagtagatttccaccaggtccgcataagaaaccacgctggggtcaaaggtgatccggaccgcctcggtgtgcccggttcccccggccttaacctgctcgtaagtggggttaaccacgtggccgccggtgtagcccgattcgacctttttaattcccgggtaggtgtcgaagggttggaccatgcaccaaaaacacccgccggcaaaaattgctgtttcactcgccatgtttcttcctccttagttcttaccgaattgtggccaggccgcgatttgcgaacccttgtaagtcttatcgatgaccttcttagtggcctcggtttggtaggccgccacgatcttcttgtaggtggcgttatccttgttcttttcctgggtcgcgatgatgttaacgtacggcttggttgacttgttgaccggttccaggtaaatcgcatccttcttcggggttaggttagccgcttcggcgtagttcccgttgatgatcgaagcgtcgaccgaatccaaagcccgggccgccgtggctgggtcgacctctttaaacttaaagttatgcgggttggaagtgatgtcgtttaacgacggcttgatgccgctgtcttttttgaccttgattaagcccgccgattgcaagaggttgagcccgcgcccgagggtggttggctcgtttggaatcgcaatcgtcgccccgtctggtaagtccttaatcaacttgtaattcttggagtacaggcccagcggtgagatcacggtgttcccaatcgataccaggtgggcgttttccttcttgttgtaggactcaaagtagtagcgggtcaggcaggagtgcagatcgatcttaccatcctttagggcgacgtctggttggacgtagtcgttaaagatcacaaacttaagggtgatcccgtcttttttcaaccggctggccacgttcttccaaaccggcagtgagtcggtccccaccaggccaaccttgaccgtcttgtgactagtgctggccaggcgctggtgcactaagccgccaatcccccgagcacgactaacagggctaagactagccacaaccatttgcgataacgtttttgcataagatatcctcctcgaaaagtccaaaagaaaacgccccatgaggcattactacctcatggggcgttgatcaacgtgttaccacccattttcagtccccgcggggaccctcaaccggctccaacaagccgtaacggtgataacgggcgttaacccggtcggggctcaccactggctcaccccggcattgcacaaagaccatcttcaaccgttcagggagttcagctttcaccaagcgctgactctctgggcacccctcccggtttactcatctttctaacttttctttaatttgattttaaaggtatcatactgaacccagcctaacctgtcaagctgaaatttaataagttatggatggctaacaatcgagactgggaaaattctgctttacccagctgctcgttgttttcccgaatattagacagataacgtggcaaataaccgcaggtctagtgtctaagtacggacgaagaacgatgcgtaccgcatcaaccattcgtcctagcttagtcaatacgacctgccgaggaggttatttgccactcactcctttccagtgctgatcgataaacttctggcggccgccggcttcttcgatcatcatccggaagggatcctttttatagaagtcctggtggtattcttcggccggatagaatggttgggccggttcaatcgtggtgacgatcggttggtcaaagcgcccgctgtcctggagtttttgcttcgaagcttcggcgatccccttttcttcttcggtttggtaataaatcaccggccggtagttgtcgccgcggtcctggaactggccaaaggcgtcggtcgggtcggtctgttgccaataaatctctaccaaatcggcgtaggaaaccttactggggtcgtaggtaatttggaccgcctcggtgtgcccagttcccccggcgcagacctgctcgtaggtcgggttagccacgtggccgccggtgtagccggacacgacccttttgattcccgggtaggtgttaaagggttggaccatgcaccaaaaacacccgccggcaaaggtcgccgtcttaagttctgccgtcatctgatcagatcctttctgcttgtccttgcccctaaggttaccacgtttagttagttttgcccgccaacttgctcaccaccaccccaattggtcagggcgttgcgaccattaagcaaagcccggtcaatccatgtataatggacaagttagaacattagaaacgaggaatgaattatgattggaatttgggccaacgtcgccgcaataatcgtcgggaccgtgatcggctgggtctttaaaaaggtgctgaccgacaagtacgtggccaccttctggaccgctttagggctggccgccctcggggtcggggcgcaaaccgtcgtcgccaacctgcccaagagccactacccggtcctgtttatcatttcgctagcgatcgggctgccggtcgggacctggctcaagctcgacgaccgggccaacgcttggatcgaccggaccttccacaccgcactaggggaagcggtggcgaccgccagtttcctggattgcatcggcgccctggcgatcctcgggccggttaacgccgccaccactggcaaccaaaccttcttgtacaccaacgccatgctgaccctggtctgcgcgatcgtctttggggccggctttgggctggggatgatcctcgaagtaccggtgctcttcatctggtttaccgccatctacttggtcgccaagtttttgtcggcctcctttttctcgccggctttgatcaccgaaatgtcgatcgtcggcggcctcttgatcgtggcggcctccttttccttgctcaagatccgcgagtttaagagcatcgacatgctgccggccctcttagtgccgctgctcttcttcattggcctggccatcttttaggtgaccgccatggcaacggtcattactagcatcctcaccttcatctcgaccgggatggactacctaatggtgctgttaatcttgtttcaccgctaccggacgccccgccagcggctagcgatcatctgcgctgactacgccggcaccagcattttagtcgggctcgccctggtcgccgctttgattttacgccgggcccctgaccagtggttactcggcttcttgggcctggtccccttagccattgggtgccacctgttgacccaccaagaaagcatggccacccccgccaaccgggtttccgccaaccacctctttttgaccgtcaccttcatcacggtcgcctcctgtggtgccgacaacctgggggtctacatcccctacttcgccacccgcacctcccccgaactggtaatcgtgctagtcacctttgccgtcatggtcgccgtcttttgcctcttggccaccatcatcacccacctacaggccgtccgggcactcctggaccgctacgggaccctgttagccggggtgatctaccttggcttagggatcctgattttgggtgaaaacggcactgcccttcatttatggcacttaattcaccactaatcgcaacagaaaagccccggtgtgacttccgtaatcacaccggggctttatttcgtaagcggtagcgtcaaccaccactgactaaagtctgggcagtcgcttcggcgttaccgagagcgtcttttggccacggaaggtcacgaagccgggcttggcgccgtttggtttgtggaggcgcttgaccggcaggtagtcgaccggcacgttgtccgagtcgcggcccttggagaagtaggcggccaactgggcgacttctaagatcgtttcgtcactgggcgccgggttacgtaagacgacgtgggaacccgggatgtccttgacgtggaaccagaggtcgtttttgttggcgagtttaaagctcaatcggtcgttttgcaggttgtttttgccgaccaggacctcggaaccgtcactggtgtggaagagttcgggcttagccggttgaactttgcgttgtttctttcccttttggcgccgtacccgcaagtagccctgttgctcaagttccaagcgaatttcttggacgtcggccggcgaggcgatgttgatctggctgacgatgttttcaaagtagttgatctcttcgttagccagggccagttgttcctggtcgtaagcgacactggccttgagcttgttgtagcgggtgaagtagcgctgggcgtttttcgacggcgacagttccggggccagttggatctggagcggccggttttcgtcgtagaagttgggcagttcgatttcggtcatcccggccttgagttgccctaagtaggtggtcagcagttcaccgcggatccggtagtcgtcggcactttcggcgtcggccagttcctggtttaacttcttgaccttccgcttgtcctttttgagctcgttgttaacgacctttaagacctggccggccagttccttggtccggtcgtgttcggccttggcggcgtagtagccgtccaaaagctcggacagggtggcaaagtgggtgatggtgagcccggtcgggtcgagtggcggaaaggcttcaaagcgctgcttgccccgttggtcttcaatcaggactggttcggggtgttcgaagtgacgcaagaagccctcgtaagccgtcggcaggttgtcagccgccagcagttcggccgccaattccgcggcgctatccttgccaaagccttggtattggtgctgcaaagctttggccaaaccagcctggtcaccctggaactggctaaagagcttggggtagtgttggttaggcaggtaggggttggtgcgttcttgcttgggcggcatccggaagagcgcccccggcaagaggaggcggacccggttttggtcggagccgacgtgcttaatcgtgtcgatgatcttgccggtttcctggttgaccaaggaaacgttgctgtggcgggccatgatttcgacgattaacttgaggtgctgggtgtcaccgagttcgtcgcgggtcgtgaaggtaaactcaacgatccggtcgttatcgacttggctgattgaatcgatcagcgccccttccaagtacttgcgcagcgtcatggtaaagttagacggcaccgccgggttcttgtagggaacggcggtgatttggagccgcgggtaggtggggttcgccgagatcaaaagtgggtgattcttccggttagcacggaccaccattaccatttcggccgggtagggttggttaatccgggcgatccggcccccggtaagtagttgactaagttcgtgcaccatggcgtgggtgaaaagaccgtcaaatgacatataaaattcctcgcttccgaatcaaattattctaatttaatagtatacctttctcgtcccctaaatgcgaattggggggccgtaatgattgtatttagggggtatctatggtattttgatatttacgggattgaacagatcccccgcaattattcaattaattttatttacgacgatggaggacccaaccatgaaaattgctgttgttaccgacagcaccgcttacctctctgaagaagaggtcaaggcgaataatatttttgtggtgccaattcccttgatcattgacgggcagagttaccgtgagggcgttgacatcaccaacgatgagttttaccagcaactggcaacctcaacctcgtttccgtcaacctcccagccaccgctgggtgagctgatggagctgtaccaatccctggccgaccagggctacgacacggtgatttccattcacttaaccagcgccatttcgggcttaatgaatacggtcacccagctggccgaagagatgaaggacacgattcaaattgtgccctttgactcccacctgacgatccggatgatgggctacctagctctagaagccgctaagttagctaagcagggcgatgacttagacgacgtaatgaagaagctccgcgagtaccgcgaaaccttcaacaacgtcttcgtggttgatgacttacaaaacctggtccggggtgggcgcttgtccaacgcctcggcctttgtcgggtcgattttaaagattaagcccctcctgacgatgcacaccgccaactacgcaattgaggcctttgaaaaggtgcgctcgatgaaaaaggcgaagttacgttgcgaacagatctttgaccaagacatcgccaagctcgactacccggtccgggcgatggtcgttcacgccaacgccaaggaggccggtcaagagtggctagctaagttgcaacaagatcaccccaacgtgtcctttgagctgagctactttggccccgtcatcgggactcaccttggtcagggcgccttggccatcacctggatgcaagatacacgaaagaagccgttagcatgaccaatgaagtccgcgaatggttattttctttggcctgcctagtcgtgatggtgatcgtctcctttgtccaatggcgcttcgccctcccaatggggacgattggcatcattgaagtgggaggtgccttcggtttggcggcgatgatcggcgttggcctgttcaagggcggaatcgtcctagtcgccggtgccttgatcatgatgctgaccgaaacggccgactggattttggccctgaccctgctagtggtcgccttagccattgccgccgtggttggttggcggatgcccttagacattcacatgagcgccagccaagggattaccctgggtctaatcgtcgggttggtctacttactgacccggctggtgttgacggtgctgtacgcctacttgttgacggccaactggacggtctcctttggcttcggtaagatcgctttggcccccgtcctcttggcagccctgctgtacgcggcgatcgtccccctggctggcctgggggtacgtcacttcaccgagcacttgagctcgggggggccgaccaagccgaccgggtcagtggaaattaaccttagtgcagataaagacaagcaacagaagaaatagggagcgtgctctaactctgtagggcctagggtggagcacacgttacgtcagtagtgaaaagacaaattgggggctgggaaaacacgtttttcccagcctcttgctgtattcacgaatgttagacagaaaatgtggcaaataaccgcaggtctagtgtccaagcaggccgaagaacggtgcgtaccgcaccaaccgttcatcccagcttagtcatacgacctgccgagaaggttatttcccacccacctttcagatcggaggagcaaaatgaagatgatcatctcaccggctaagcaaatggttagcgatgacgaaccactggttagcccaacccccatccgctttcccgaccaggtgacggagttgatggcggatttaaagtcgcgcacccccgccgagttacaagaactctggcggtgcagcgataagctggcccgggaaaacgtcgcccgggtgcaggccttcgatttaaagcgggtcgggaccccggctgtctttgcttacgcgggaattcaataccaatcactaggggcgggagtgttgaccgaccggggtttgcaaaaccttgggcaacgcttatacatcttgtccgggctgtacgggctcttaggggccttcgacggcatcttgccctaccgactcgaaatgggggctaagggcgaaattgccggtaccaagaacctctaccaatattggggtgcccgcctttaccaagcactctttgcgagcggtgacctagtggttaacctggcctcaaaggaatacagcaaggcgatcaccccctacctcacccccgctgaccggtgggtaaccgttttgtttaagcaagaaaaaaacggccgcctggttcaacaagcgaccgcggctaagcaggcccgggggtcgctggtccgatacctagccttagaaaacgaacctaccttagccaccattaaggcctttacggtcggcggctaccgctaccgagcggacctttcgacggaagcggagtacgtcttcgtcaaagactagcgttgggcttgccactcggcatcaaactcagccaaaaagtcgatcatcacttgctggcggtgcgcagcgatttctttggcgaccggggtgttgagcatcccggctaacttgagaagtttttcgtggaagtggttgatgatcgtttcgtggtccaagttacggtattcgtccttagtcaggttttcccgcgggggcatggccgggtcgtaaatgacttggtggtgcttgccgccgtaataaattgcccgggtgatcccgatcgccccgatggcgtcgagccagtcggcgtcctgaacgatttggccggccaggggcagggcgggacggttaccgtctaaggtgctagcaaaggacatctggctgatgatcgacatgattagttcaacctggtctgctgtaaggcccagcccagtcaaaaaggtggcgacctcttctttagcggcgtcgacgttatcgactagcttgtcatcgatcgtgtcgtgtaagtaggcggccaccaccggaacaaagggatcctgatccattgcggtggcaatccggtgggccatcttaaccacccggcttaggtggtcaaagccgtgaccgctcttatcttgccccagtttttgtttggcaaacttggcgattgccattagttgtgcttgtgagtccatgagaacctcctgaaaattgatactctcaccttaagcccttgcgtgtgcggacgcaagggctttcgtttggaagcggtgggcaaagggcggtaagatagataaaactagaaagggtgatttgaatgagtaaaatttttgtcgctggagcaactggccgggttggccaagaggtcgttaaacaactagccgctgctggtcaagaagtcttagccgctggccgcaagctcgatcgcttaccaaagggggagttgattaccccggtcgcatttgactttacctggcttcccgaccaaatggccaagttgctgaccggcgtggacgcaatcgtctttaccgctggctcgcgggggaaaaagcttttacaggttgacctcaacggggcggtgaagttaatgcaggccgccaacttagccgggatcaaacgcttcgtcatgctcagttcggcctattcaatggaccaagcgatgtgggggaaggtaaagaccttgagggacatcactgattacaacatcgcccgctactttgccgacaagtggctggtcgatgaatcaggcttagattacaccctagttcaggctgggatcttaacggaagaaccggggacggggaagattgaacttaaccccgcccaaagtgacagcaacgcaatccccgacgtggcacataccattgtggccgctctggctgaaccggcgactgtcaagaaagtcttcatcattaaaaacggttcgacaccgatcgaagaagccctcaagacttgctaggcatgtaagcggcgccaatcgtttggtttgaattttcggtaacaaatatgctaatgtggtagacgttatcttaaaatttagaatgaaagaaggttccagcatgcacttgacgaaggcaacgatggacgaccttgaccgggtcattgaaattttaaaggacggccgcaaccaactggccgaacggggaattgaccagtggcaaggcgactaccctaatcccaagcaagttgaagaagacatcaacaagggggttgcttacctagttcactccgacgatcacgaaacggtgggcgccttttcaatcgttccggccccggatcccgtgtacgatgccatggacgggaagtggcagctcaacacggaccagtacctggtgatccaccgggttgccatccactccgctcacgccggcaaaggctacgcgtccggtttgtttaacaacgtgattgactacatcaagcaaaaccggccagacatcctgtcgctgcggatcgacacccacgaagacaacgtgccgatgcagcacctgattgaaaagaacggctttacccgggtggggaccttatttggggtttaccggccggaagaaaattcctacgtctacgaattattaacccaagggtaggcacagtgaccttagtactacaatccaaaaggtgggtgggaaataacctcctcggcaggtcgtatgactaagctaggacgaacggttggtgcggcacgcaccgttcttcggcctgcttagacactaggcctgcggttatttgccacattttctgtctaatatttgtgaatacagcaggaggctgggagaaaacacggttttctcccagcctccttttttgcattcggatcgttagctaacggtgacccccgttggatggggggttaagggaaccagccgtcccggcaagcccgcctgggtaatggcggcctgaaaggcggggaagtcggcttctttgagcagggtcatcacggtcggcccggccccgctgaggtaggtagccagggccccacaccggtggccgagctcccgcagttgggttagctcggggaccaggtgggcccgggcttgctcgtggaagcgatcctgttcgatcagttgcccgaccagttggtagtcaccggtaaatagggccgcgacgagggtgttggccgtggcactggccgccaccgcctccttgaaggggagggtcgttggtagggcggcccgggcctccttggtcttaacgttataggcgggaatgtaggcggcaaataaatagggcggtaggggtgctttgacggctgcaaacccaccgttaacttcagtgccgatcaccaatccgcccaagatggtgggggcgacgttgtcggggtgcccctccagttggcaggcgaaggccaccttttgttcgtttgacaggtgcaacgcccctagttggttggccaactcgatcccggcgacgatcgcactggaactggaacccaggccgtgggccaccgggatgtcactttgcacggcgaggtggtgtggtgtgaggtcgggtacaagctgacgggcggtttgaacgatcaggttactctcgtcgtggggcaagtcggccagttggtggtcgacttgccagctagtggccggcccgaggacgtcgacggttaaaagaagcgacagggcgacgccgattgaatcaaacccagggcctaagttagcactggatgcgggaacaataatctgcatggccgcctcctaatctaaaaccttgtaggccgcctgtaaggacagggttggtgactggtcaagcagttccttaagttgggccagttgggcctggttaatggcgtgggtgatcacgaccacgtgggcgtgcccctggtgggcggcggtttgcaccagctgctggaagctagcgcccacctgggtcatcaagccggctagctgctgcatttgccccggcacgtccggcatcttcaaggacaggtagtaagggaaactaaccgccttggggtcggcggggcctaactcctgggcgaagttattaaaggagttcccagtcgtctttaacaccaggtttttggtggtggaggtaatgtcgctcaagacgctgttagcggtgggtaagcccccggcaccgggcccgtaaaagagggtgtcgccgaccgcttggcccgtcaccatcacggcgttgttttcgttgttaattgaagccagtgggtgggactggttgaccaaagtgggcgccacctcgacgaagagaccgtggttgaccaccttggctaacccaaccagcttgacaacgtagccgagctttgatgcttgggcgacgtcttctttggtcaattgatcgatcccaacgatttctaactcatcgacggcgacctcggtcccgaaggcaaagtggctcaagatgaccatcttaaaggcggcgtcctttcccttaacgtcgttggtcgggtcagcctcggcaaagccgagcttctgggcctgtttgagggcagtatcgtaatcgagcccctgcttagccatttgggtgaggatgtagttggtcgtcccgttgacgatccccttgacctccaagatctggtcggccgaaaaactattggcaatcgtgcgcaggattgggatccccccggccacgctggcctcatacattaggtcgcagtggttatcgtgagccaactgggccaagcggggaccaacggcggcgattaaatccttgttggcggtaacgacgtgcttgtgctgttttaaaagggcggtgatgtattcttcagccgggtgcaacccgcccagtaattcaacggcgatgtcgatttcctcgtcatttaagatctcggcgaagtcggtcgttaaggtaaccgagtcggccacggcctcgtgcttggccggattacggaccagcgccgttttcacggtgatccgctgtccggtgacgttcgtaattttatccccgttttcttgaatcatttttaacactccggacccgaccgtgccgagccccagtaagccaactttgatttctctcattaactccacctctctttaatctttttttcattttagtgattgtaacacgggcgtaaattaggctacaatagaaaaaatttatgagatcatttttttatacgggagggagatcacatgcaataccgaagcacccgcgaccaagtggccaagcaaatgacggcgcccgaggcgattttacaggggttagccccggacgggggcctctttgtgccccagtcgtttccccaaccagactacgacctgggggccctcgttaacgccccctatcaagaggtcgccaccaccatttggggctggttttttgacgacttttcgctggcgagccgtcaagcaattgtccggggggcctatggtgagcagtgggatgattcccagattgcacccctaagcgagcgggtggcggggaattattacttagaactcttccacggcccaacgctggcttttaaggacgttgccttacaagcccttccccggttgatgaaggaggcggtcacggtgaccggtgatgataaacaaatcatcattttgacggccacttccggtgacacgggctcggcggcgatgcggggctttagtgacgttaccgggacccaagtagttgttttttacccggacggtggggtgagcccagtccaactgcgtcaaatgctagcgatgaagggggataacctggcggccgtagcggtggccggcaatttcgatgacgcccaaaccgaggttaaaaagatctttaacgaccaagaatttgccgctcggttagcccaggcgggcgaccgcttttcgtcggcgaactcgatgaacattggccggctgattccccagcttacttattacttcaccgcttatggccagttggtcaagcgcggggaagttgaactcggcgccccggttaactttgccgtgccaaccgggaactttggggatatcctcgccggttactacgctaaaaaattagggctgccgatcaacaagctcctgtgcgcctccaaccaaaaccgggtcctgaccgacttttttgcgaccggccactatgaccggcgccgccccttccacctcaccacggccccggcaatggacatcctagtttccagtaacttagagcgcctcttgtttgacctgtatgaccaagaggcaggggcggtggcttccttaatgaaggaattgaaccaaacgggcgaatatcaagttaccgacgaagttttaaagcgtctgcaccaagactttgtcgctgattgggccagtgaagaagaaattagcgaagagattcgacggatctatttggcagctgactacgtcattgacccccacacggccgtgggttcggtggtggcgcaccgatataaagaacggacgggggataacaccccgatggtggtggtcgccaccgctagcccctacaagtttgccgaaacggtctacccggcggtaacgggaaaggaaacggcggcgcgcgggctgcaagcaattcaagggctcaacgaattcttaggtgaggagttaagcccgggggtcaaggccctgtttgaaggggaccaacgctcagaacagcgggtggaaccaagtgagatggcccaactaattgaaaaacggctcggcttaacgagtgagcaaaaggaatgattgcttaatggaagaacaagtttcaagtaggcggcacgaatggcagattgccctaacggcttcggccccggtgatgctcggttacatcgtcttaggattggggtatggtctctacacccacagcctcggcttttcctggtgggtaccaactgatggcgctaacgatttacggtggctcggtcgaatttgtgatcgccaacatgttaacccaggcctttaaccccctgaccgtcctggtgattaccctggtggtgggctttcgccagtttttctactcaattgccatgttgggtaagtacaaggggcacggtttccaaaagttctttcagattttttctttaaccgatgagacctttgtcgttaactaccagcttcggttgggtgatgacgtggatcaccaacgggtgtatacgatggtggcggcactcgattacttttactgggtgtttggtacctggttaggtggcaccctggggagcattttggccatccaaattaagggcctcgactttgccatgaccgccctctttttggtcctcgctctcgaccagatcctcaaagaaaagagccacgttagctcggtgtcgggtctcgggattacggtggtttgcttaacgctggtggggtcaacttactttctcttggtgaccctgctactattagtcgttgaattcactattttgtaccggcggaggacgatgaaatgagtttagttcagcaattgttaacaatcgcgttcgccgctagtgctaacttcttgactagggtggtgccctttcgcctctttcaacggggcaatcaaacgccacgctatatccaaggactaggggagtttttacccggcgccattatggtaatgctggtggtttactgcctacgtaacgttacttggttgtctggcaaccatggttggccggatttgattgcttgcacgattacgattttagtccacctgaagtggcggtccctgtttgcttcaatgattatcggcaccaccgcctacattctaatggtcaactttgtcttttagacgacaaggtgggtgggaaataacctccttggcaggtcgtatgtaagattggacgaacagttggtgcggaacgcaccgttcttcggcctgcttagacactagacctgcggttattttccacattttctgtctaatattcgtgaatacagcaagaggctgggagaaaacacagttttctctcagcctcttttttacgttttctgattaagctaaggcaatcgaccaccacagccacacctttaagactggccgtaggggtgcgcacctattaatgaacaagactagtcgccccaaacctctttggcaatgttaaaagcggaccaagcgtttggccaaccaacgtaaaaggcgagttgggtaatcatttcggcgatctcttctttagtaataccgttggccttggccgtttgcatgtggtaggggagctgttcaaaggcccccttggtgatcaaggcggtgaccgttagaaaggaccggtcccgcaaggaaagtcccttttcccgggcctaaacctgcccgaataagacatcatcgtttaattccgcgaatttcggggcgaattcccccagctggtcgcggccagcggtttgctttttagccatttaaatcatcctttctccagatcgttaataccattataaagaagccaatttgaaaagttaaataccttcttagagggatagttaatacccaaagtgcattattgattcttagcaatggttgattattagcaattaattggacaattttcactcaaatcaatagttaaaaaacaatgagttttagtaaaaatttttaaacgatttcacagatggggattaaagcctaatgtaacggctttcttgatcgatcgctcaacgatgaacaatgtttacgataaatgaaaagcgtgtataataggcagtgtaagcggtaacttaattatcctttttactttaaggagggcactataatgaaaaagttagactttgaaagccttaagcacaaccctgagtacgaggttcttcaggtcctcggtactgatggcaaggttgtcaatgaggacttaatgccagacctaaccgatgatcaattggtagatctgtttaagcaaatgatttggtcccgattagttggtgaccaaactgctaagcttagccgtcaaggccggttaggtttcttcgccccaactgccggggaagaagccagccaaatgggttccaacttcgcgatgaccaaggacgacttcctcttgggtgcatatcgtgacgttccacaattgatcaagcacggtctgtccttagctaagggcttcatgtggtctaagggtcactacaacgctaacgactacccagaagaattgaacgctttgccaccacaaatcatcattggtgctcaatacgttcaaactgctggggttgcccttgggatcaagctcaacggcgacaagaaggttgcctacacctacactggtgacggtggtacttcgcagggtgacttctacgaagggattaacttcgcaggggcttaccaagcaccggctgtcttctttgttcaaaacaacggttacgctatctccgttccacggaagctgcaaaccgctgctccaaccctggctcaaaagggtgtggctgccggaattccttccatcgtagttgacgggatggacgccctggcggtttatgctgctgctaagcaagcacgtgactacgccgttgaaggtaatggtccagtgatcatcgaaacgctgacttaccgttacggaccacacaccctttctggtgacgacccaacccgttaccggaccaaggaagaagaagacgaatggcacgcaaaggacccactggttcggatgcgtaagttcctgactgacaagggtctttgggacgacgccaaggaagaagcctacaacgctgaagtggctaaggaaatcgacgacgctatcaaggaagttgaaagccaaccagctcaaaaggcatctgacttcttgaagttcgaatttgtcgacactccaggtgctattcaacgtgaaatcgatgagtacaaagaaaaggaggccaaataatcatggctaagattacgatgattaaggcggtcacggacgccctcgatgaagaattagctcgtgacgaaaaagttcttgtctttggtgaagacgttggtaacaacggtggggttttccgtgccactgaaggcctccaagctaagtacggcgacaagcgtgtcttcgatactccattagctgaatccgggatcatcggtttagctaacgggcttgccacccaaggttggcgcccagttccagaaatccaattcatgggcttcatcatggaagccattgacgaaattgctggtcaaatggctcgtcaacgcttccgtcacgcaggttctcgtaaggctccgatcaccatccgttcaccatttggtggtggtgttcacgccatcgaactgcactccgacaacctggaagggttagtggcccaagttcctggtctgcgggtagttattccttctgacccgtacgacgctaaggggctccttgcttcctccattcgttccgatgacccagtcttcttcctggaacacatgcgggtttaccgttccttccgtcaagaagttccggacgaatcatatactgttccgttggacaaggctgccgttaagcgtgaaggttctgacgttaccatcatttcctacggttacatggttcgcgaaagcttaaacgccgctgaagacctggctaaggaaggcatcaacgccgaagttcttgaccttcgtactgtttccccacttgacgaagaaacgatcttaaacgaagttaagaagaccggtcgtgtggttctggttcaagaagcaccaaagcaagctggtgtaatgggctccgttgctgccttgattgcagaagacgcaatcctttccctggaagcaccaattgcccgtgtttccgcaccggataccccttacccatgcagtgacgccgaaggtgcttggcttccaaacaaggacgacatcatcgccgctgttaagaagaccgttaatttctagtgaggtggatctgaaatgagtaaataccaattcaagttaccagaacttggtgaagggatggtcgaagggactgtcggcgagtggcacgttaaggaaggtgaccacatcgcaaaggatgctgacctggttaacatcgaaaacgacaagtcctcagaagatcttccgtcaccggttgatggtacgattacgaagattttagttcaagaagacgaaacagcagaacttggtgacccactggttgaaatcgaagttgctgacggtgaaggtaacgttgaagacgacggtgccgctgaagctccggccgctgaagaagcacctgctgcaacgcctgctccggccgctccagccgctgcgggtgctgctcctgctgaagcagaccactccgttccggttctggcgatgccagccgttcgtaagtacgctcgtgaaaagggcgttgacttacaccaagttacggggactggccgtcacggtcaaatcttgaaggctgacgttgacgccttcaacggtgctgctccggctgctactgaagccctagccgctaccgaagctccggcaccagcaccagttgcttctgccccagccgctaccgaagctccggcaccagcaccagttgcttctgccccagctccggctgccgcagaaggttggccagaacatgctgaaaagatgagtaaaattcgcaaggccactgctaaggcaatgacgactgctaaggaccaaatcccaatgatcactgtctttgacgacgtggttgttgacaagctttgggaccaccgcaagaagttcaagcaactggctgctgaccgcgggactcacctgaccttcatggcttacatgaccaaggctttagcagtgattatgcgcgaattccctgtcttcaactccaaggttgacatggaaaacaagcaaattaactaccgtgactacattaacgttgggatcgccactgacaccgacaacggtctctttgttccgaacgttaagcacgctgaccgtttgagcctcttcggtattgctgacgctattagcgaaaacaccgctaaggctaaggacggcaagctcagtgctactgacatgagcaacactgggatgacgattactaacattggttccattggtgggggtcacttcacgccaatcgttaactggccagaagttgccatcatcgggatggggaagatctcccaagaaccgatcgttgtggacgaccacatcgaaccagctaaggtgctgaagctttccctgactgttgaccaccgggtaatcgacggggcaaccgctcaacgggcaatgaaccggatgaaggaactgcttggtgacccagaattactgttaatggagggataattagtcatggttgttggtgattacgcaattgatttagacacgattgtcatcggttccggccctggtgggtacgtggcagccatccacgctgctgaactgggccaaaaggtggccgtgatcgaaaaggaaaacactttaggtggggtctgcttaaacgttggttgtatcccgtccaaggcgctgatccaagtttctgaaaactaccggacggccctcgaaaacgaagacgaaggaatttccgcatccgacgttaagttagactgggctaaggtacaagaattccgtgcgggcgtcgttaacaagatgaccaacggggtttcctacctcttcaagaagaacaagattgatgtgattcacggggtggccttcttaaagaccgaccacagcttacgggtaattgacggcgaaaacgcccaaacttacaccttcaagcacctgattatcgcgactggttctcacccgattgaaattcctggcttcaagtttggtggacgagtgatcgattccactggggttctggaattaaaggaattaccaaaggaactggttatcatcggtgggggttacatcggtagtgaattagccggcgcgtacgctcgcttcgggactcacgttacgatccttgaagggaccgactcaatcttaaatgcctacgaaaaggacttagttaagattaccgaaaagaagttcaaggaactgggtgtcacggtcattactaaggccatggctaaggaagctaaggatactggcgacgccgttgaagtttcctacgaacaagacggtaaggtgaacacgatcaaggctgattacgttgccgtagcagttggtcggaagccaaacaccaaggacatgggtctggaacaagttgggattgaaacgactgaccgcggcctgatcaaggttgacgctcaaggtcggaccaacaaggaagatatctttgccattggtgacatcgttgccggggctgccttggcacacaaggcttcctacgaaggtaagattgctgctgaagcgattgccgggcaatcctcagtggttgactaccgggcaatgccagccgtatgttacgtggaccctgaaattgcgacgaccggtttaacggccgctcaagcaaaggaacaaggcttagacgttaaggcttccaagttcccattctccgcaaacgggcgggcaacttctaagaaggcaactgatggtttcgttcgcctggtttccttaaaggacagcggcgtaattgtgggtgcccaaattattggggacagtgcctccgacatgatcagtgaattgacgctggccatcgaatccgggagcaccgtggaagacatcgctctgacgatccacccacacccatccctgtctgaagccgtaatggacgcagctgacgtggcccttggcttcccaactaacatctaattgattcatatgtgaggaagtagatacgatgcaatacctagcgatgaagtcgaacgacattcggcgcaacttagcaaccgaacagtacctgatgaacagtgaccaaatgactcctccgttcatgctcttttacattgaggactcatgtatcattgttggtcgcaaccaaaataccctggaagaaattaaccaggaatattgtgaagaacacggagttaccatcacccgccgcctctccggtggtggagcgatgtatcaagacatggggaacatgtgcttctcctttatcgtcccggccgatgaagttcgcttcggtgacttcaagcaactcgtgcaacccgttgtggacgccctccacgacatgggggccaccggagcgatggcgacggggcgtaacgacatcgtcattgatggtaagaagttctctggtaacgccatgtacacccgtgatggtaaaaccttctgccacggcacactgatgtacaacgtcaatacggatgtggttgcggacgccttgtcggtcccaaaggacaagattgaatcaaagggaattaagtcagttcgctcacgggtaaccaacatcatgccttacttgaagccggaattccaaaacttaaccacccaacagttccgcgatgagttaatcaagcggatttggaaggtcgataagattgaggatgcccaggttaacgagtacgaactgacggcagaagataaccaagcaattgatgaaattgagggtcgtctttacaagaactgggattgggtttacgggaagtccccggactttaccattcaaaagcggcggcactttgactccggaacaattgatgcgcgcttcctagttgaagaagggaagatcgctaacctgaagatctacggtgacttctttggtaccggtgacgttcacgaagttgaagaagccctccaaggggtagcctacacgccatcagcgatcaaagaaaagctccagcagcttgatttgaataagtacttcgctggtgaagatgcaacccaagtgattgaactactttccaagcaagaataagataaggggggccaccttggtggttccccttattgtacataggaggaagaacgatggaatggcaaagcgcatactaccaagtcccgcacgattttagtgcctacccctttagctacccacagttgagtcagctcgtgaaggtgaccccttttttgagtggggaaacaacccgcttaatgatgacaaatcattatggaaaggcgccgctgacttttgaacgggtggccattgctaatcaaccgaccatggcgggggcgacggaagttggggcggtgaccattcaaccgggacaaaccctcgccaccacaccggttgactttcaagttgaggcggggcggccagtgtacgtgttgatggttgccgagcgacctcaaacctattatgattacacttgcacctttgaaccgagttgggttaacgccggagtggcgcgtcaagccggcaaggtgccgcggctaaacgaccgctggcgggtccgtaagtcctggttctcattcgccgggctcgagacccaaccgacccaaccagcgaccgtggtcaacctaaccggagattcactggttgaaacggggatgttggcagcgggcctgtttacccttagccaacgtgacttcccgaattccgttacttggcggatgacggggatttccggcaaccggctagtgcttgcggccccaaccaatcagttgccggagaaaacctttggccccgctttggttgaccgcttggcagacttggtaaccgtatcggccaagttaacggttgcctcgattggggggaacgatctcctcttgccggtcgataatccgggaggggacgagccaattccgagtgtcgaaagcttagtccaagctttcaccaacttaaaaagcgagttggcggctcatggtcaggagttgatcgtgcccacccttgctcccttgcgcttggcaggggagccaaccctctttcaaccgggtgaaaaagaggtggaccaaaagcggcgcacccttaatcagtggctggggagtcaaccttgggtagtcgataccgcgccacagctgaccgcacctcacgccaccgtgctcgccccggaaaatgactttggtgaccaccttcaccttagtcctaccgggggacgacaccttgccgaactactctggccgcgaattaagggtgccctgatgaataactaaactagttaggaagtgaagcatggatacgcgcgtattacgatactttttgaaggtcgccgagaccaataacattacccgggcggccgaatagctccacgttactcaaccgaccctttcccgccaaatcatggacttagaagaggaattaggggttcccctgtttgaccgtcagcgtcggcaaatgcacttaaaccaggccggcgtgttctttcgccagcgggcttccatgatgttggccctggagcaggcggaaaatgagcttcaccagcagggaaccgatttaaccgggacgattaacctcggtgtggtcgaaaccggggttggaggtttcatgatggaaatggtggccaagttccgggaccggtatccgggggttcagtttgccctcttcgatggtgatggcgacagcctacgggagcgcttagatcagggagctgaagacattgtcgccttggtggaaccagtcgaagccgctaagtacaattacatgcgcctaccggtacgtgaagaatgggagattatcatgaaaaaagatgatccgctaacccgccgcgacgtatcaaccagggaggatttgtatgacctaccattgattgtggggcgcgggggatcatgcgcgactcagttagcgacgttttgaagctcgatcagaccaagcttaatattccgatcactatcaacttaccaatggtctccagggacttggtggttaaccaccactattaccacctaggaatccggggcgtttacgaaatgtacaaagacgacgacctcgcctttgtgcccttttcaccccagaaaacgagtgggcacctactcgcttgacgcaagaacacgatcttgtcgccggcggtggaaaagtttctccagttggtagcggccaacgggggcgaaatgtaacggctaggtggtcaaacttgctagtccagctagataaggacatcagccagaacgtcaatagaatgttcgagaagctgaaagaggccggtaaaaacggattttttcccggcctctttctgtattcacgaatgttagtgttgtagtttacggatccccggtagggtttgggagaccaggaagctaacgacgtaaagtccggctaagcatgccatcgtaacggctaagctgtagtggtccatcaaaatcccgatcacgaccgaggagaaaccaccaattgcccggccgacgttcataatcatcgagttggccgtcgagcgaatcgcggtgggataaaggcgggaaatcatggcgccgtagccaccaaacatcccgttggaaaagaagccgatcagggccccggcgaggatcagggcggtggcggatttaaccaccaagatgacgaacatcacggccgcactccctaataagaagattccgaaggcgacccgggggcccaaccggtcgaagatggttccaaaggccaccatgccgatgctcatccctaagatggtggcgatcatccagatcgaagaaccggagacggttaagccctgttgtttttgcacgatcgatggtagccagttcatcaacccgaagtagccggcaatttgtacgattgtcatcatcatcaggcccagggtttgaaccgctaactgcggggtggcgaagagccgggaaatagcgaccttttcgtggttttgctgggcttgcttttgggccgttaagaagctagccgattcgtgaacgtggcgccggatgaagtaggttaacaccaccgggataattccgagtaagaagagggcgttccaaccgaagctcgggatgatccaagcagccatcaaggcggcgaagatggcgccgacttgccccccaatggcggctaccgaggacatccgcccaatttggtgggtggagaagttttcggcgatcagggcgatgccgaccccgtactcaccaccggcaccgatgccggccaaaaagcggagtaggtagatcatcgggagtgagtgggcgaaaaacatcgctgccgtggcgaaggcaaaaataaagatcgtgtaagagaacgtcttgacacgaccaatgcgatcaccgacaaggccgaaaaccgcaccgcccgcgagcatcccgaggttggtgattgagccgatccaccccgccgccgcactggaaatgtgcaggctagcaatgatcggggcgagggcaaaggagagaaacatgatatccatgttctcgagcgaaaaaccagctgctgttgaagccatgacccacttttcgttagtggtcatggtgttagcttggcgtgtccctgtctgttccatattcaattcctccaaaatgggcgctctctggcgtcctttatttcgtatcgcaagtattatgtcatgaattgggcacgctggcaagtgaaaatgaagaaaagatgaataataaatggtgatcgattatgattgttcggaaatgaaaaaccgccggcgcacacggcgtcggcggctttcttagcttaattaacccttggcaccgctactggtcggcacgggggctttgccctggtgagctgacttagtagccttagccttggctttggtcttaataacggttacccgaaattcgttgacgtaggcgttttccaagtcgaggggggtaaaggagaagttttccacccgaattggttgacccaccttcaagtcgtactgttgctccaggaaaaagccggtcaaagttgacacttgggtctgttcgaactggggaatggaaatcttgaagtagcgcatgaaatcatccagtggcatttttccggaaaccttaaaggtggggtttccttgggaatcgggctgggtcttttcgatcatgtcggcttggacgtgatcgatttcttcgccgatcgtcccgaagagttcttcgtagatgtccttgtcggtcacgatcccagaggttcccccgtactcatcttgcacaatgaccattggaacctgctttttgatcattatctgtaaaacgtcggtgatcggctgattttcataggcgattggcaagcgccgcacgatggcccggattgattcttccgggttgatctggttttggcgcatgatgtcgtaagagaagatgtaacctaagatgtggtccttatcgtgattggccacgaccgggaagcgggtgtacttcttttcaaagtagaggtgggcggcgtcatcgatcgtttcggtgacgtcgatcaccgttaactgggtccggtcgaccatgatgtcgccggccaccttgtcgttcatcttaaaggcccgttccatgaataaaacgtcggcccggtcgagttcgccggccttctcagattcctgggagagggagacaatttcgttttgggtgtagatgtcttcatcggggtgaatcgaaaagccgagcaagcgcgtaatggcggccgctgagcggtcaaagatccacaccagtgggaagaagacgacgtggaagaacatgatcgggtgaacgatggccaggagaatattgacgggtttgtcaatggcaatgttttttggcaccaggtcggtgaaaacggcgtgaagaaaggtaaagaccaagatcccgatgactgaagataggtcgttggccacggcggttggcaacaggtgccacttgatgatcaaagccgtgatgtagccttccccgatccaccctaagatcagggaggtcaaagtgatcccaacttgggcggtggagaggtattccgttaggtgatccaacatgtgcaaggcccgcttaattttgcgggtctgcttcatggtcctcagttcggttggccgaaccttaatcagggagtattcgagaagggtgaacaacgctgccaaggcgaggatggcgacgatgatcaccaatattgcggggctggtactttctatttccatggattaaaaaaaatcatcctttccaaattaatcaatgttaagagcaattatagcaattcaaggccgggaagggaaagaaagtaaagtgattttccgtattttctgtctagcctgcggaaattaaaaagctgagggaagtccgcgcctatctcagcttcgtcattttaattagttggggtggttttcttaccccgaaagaggagcaccagccctaggttaaccagcaaggtgaacccggtaacggcaaataccgccgagtaagaatataccccggaaatcattgaacccatgaccgaaccaagtacggaaccggcggcttggaagctctggttgtacgagaagacccgcccaaaggcttcttgggggacgtcgagggtcaggatcgtttgggccgccggtaagagggcggcgttggctaaccccaacaagaaacgccaaaaggccaggtgccacggggacttagtaaagatcattggcacgaacagcagggtggcgattaaaagtccccagatgaggaccttcaagggaccgatgcggtccatcgtgtggccgaccttggaggcggccaccaaggtccccatccccggggtggccgccaccaccccggccacgaaggcaatgttaccctggttgtgcatcagttccttgacgtacaaggagacaattgggtcgattgacatcaccgaggattgaacgatcatggtggtgataaacatgaccacgatcagcttcacgttcgggattttgtgcatcagttcgcccattggcttgagggcctgcttagtgatgggggtgaactgttccttggtgatgaaccaggttgcaaagaagacgacgagcatcaaaaaaccggtgatgaaaaaggggattcggtagccaaaccatcccgatagggtccccccgagcagcggcccaacgagattaccggtcaccccggccgtcatcatggcggccattacccaaccggacttagagtggggtgtttcaccggccatcagcgccgtggcgttgttgatgtaaccagaaaaggccccctgtaaaaagcgcaggacgatgatcatccaaacgttggttgacaaaccggttaaaaagatggtgatcgccatcacacccgacgcccgcatgcacattagtttgcggcccttgcgatcggctaacgaaccccaatatggggaaacaattgcctgggaaataaaggtcatcgcaaaggcgagtccggaataaaggttgagctgcaggcgggagaaatgtcccagttcgttgatgaacagggagataaagggcatggtcatcgaatagcccatcccggtaataaagctgccaatccagagggtataaaaggttttgtgccagccccttggtaggtgttcgctggtgacgttagtatccatgatactcaggttcatctccttagaaagtggttataaagtggtggcctggcgtttttggtaggccaggtaagaccaaaagacaagtaacatcaaaacggctaataatacagtcacccacatggcgagcttgatcccggcaaccagagaggcggggatgtcggcgatcactacgcacatggtaacggccaccgccccaaatgattggcgtagggtgttgtttaaggccgacccgtggctgttctcccgcttagaaagggcgcggaaggcttcggaaagggctggtgaaaagaccagggcgttgccgatcatccggaccgtgtaagcgagggtgagggtcagtaacgaagaacgagttgagatcgtcaccagtgggatggaggccaagagaatcaacagcccccccgtggtgattaaccacttgggaccgtactggtcataaagcttgccggcaaaaaaggcggtgatggcgttgcaaatggcgccggggagcaggatcatcccggaaataaaggagccggtgtggcggacgttttcggcgtagattggcaggagttgttcggtactcaaaaggaccatgaaggccaaaatcccgacgatcgtcattaaacaaaaggaggggtaggtcataatcttaacctttaagaccgggttggttagccgtaattggcgccggacaaagagggttaaaattaccagcccgctgattagcatggcccaaccgagggcggaattgacggtgaaggtagtcaaagaacctagggtcagggcggaaccaatcaaagagatgaccaccgaaaagaagtcgatgtgaatggggtggggcgttgagtagttgggcaacatgaagtaacccagtacacaggccaacaccatgaaggggagcaccaaaataaagaggtagtgccagtttaaaaaatgtaggatcagcccggccgtggacggaccaatcgccggtccagcggcaattaccagggaagagaggccgaggatcgaaccccgcttttcgggcgggtaaatcgagatcatggtggtcatttgaaacgacatcagcattcccccggcgcaggcctgaatcaaacgggcagccaaaagcatcccaaaactggttgccacgcagcccagtaaggtgccggcgatgaaagttccgagggtacccaagaagacctggcggttagtgaagcactcgtacaggttagacgaaagcggtgtgatcaccccgatcatcagggtgtagcccgtgatcagccattgaacggtattgagggagcggtgaacgtcgtgttgaataaccggcagcgccgttatcatcatcgtctggctcatcaggctaatgaaggttgaaacaagaaggatgatcgttaccatcttgcggacgttggggtcaattttggtatgcattaacatttcctttctaatggtcattaaacgccagcccccggtaaccatcacttactgaggaccgcaggggtgctcagtttcacccctaaaaaacacgatgggtcccagtaatgttcgcagccgaaccaccagaacccataacggaggatactatgacgccactaaggcataatattatcgccgttgttgtaaatgcccctttattctaacacttttcttgggtatgaaaacgaccaatgtgttatcctaaccacagaactgataaggaagggtgcaagacatgggagaaaaaatagcggtcttttcggatgtccacggctcagcaacgggtttggcagcggtttaccaggatgcccagcacttaggggcaacggactactggttcgtgggcgatcttttaatgccgggtccgggggtcaacgaggtttgggacctcttttgccaaatcaacccctcgttaattgtccgtggtaactgggacgacctagtcattaacggggtggccgggcggatcccgccgacgaaaccctcgcgcttgtactttggccgcctggcccagtacgtagccagccgggtacaaccaggggtggtcgaacaaatggcgaagtggccactgcaacaaacgcgccaggtggggaaatacacctacacggtaagccacaacctccccgacctagcgatgggccaggacctgttcccgactaacccggcgcaaaactttgaccggctcttctccggtcaaacggcagcgaccacggctcaggtggccatttacgctcacgttcaccacgaactgatgcgctacgccactgacgaacgcttggtcttaaacccgggctctgtgggggaaccctttaaccggcagtgggacttgcaagcagataccagggcgcagtacatgctgttagaagtggatgagcaagggatcgccgggattaattaccgtcacgtcgcatacgacaaggaagaagattggcaaatggcgtgcgactatgacctcccttacctggagctctaccggcgccaacttgattccggtcgggtcgatacccataaccaggaactagtggccaaggtcagcgaggaacaccattacgcacaggagtacgcggcctttgttaaggaaatccaacaatcgaagtaaaacacttgcaatttctggggtgaacagtaataattactatttgaattgacgagtgaatgagtatgttgaagcgacgtgaaatttaaaatttaggaggaaagtatggctaaaaaatcaaaaattgctaagttagaacaccaacgggcgacggtcgccaagtacgcggctaaaagagcggccctgaaggaagcgggcgactacatcggtttgtctaagctcccccgggatgcaagtcccgttcgcttacacaaccgcgatcagtacgatggtcgtccccacgcttacatgcgtcagtttgggatgtctcgtctgaccttccgggaactcgcccacaaggggcaattaccgggtgtcaaaaaggctagttggtagtaacgtttaggaaggacgtaatcgatagctacggtattggtggttgcctaccgtcctttttgtcacatttgaaaatagactaagggctggggaaaacgttctttcccggccctttttctattggggtggtatacttaaacgataatacattagaacggaggagcccctatgattgacgccattgttaaacgaacggttcgctatcgccaacattcctttatccgggtggtacgacggaccctggccgtcatcttccccttagccttaattggcattatcgcccaggtattgttcatcgtttttttctctaacgatggatacttatacaacgttttatcgatcggggattgggtccctaaggtggtcttaaccaaggcgcagtattccctgttagccctctcacaggtcacaattgagatgctaacggtgtacgcggcttacggggcggcccgctacaccgcccagctctaccagattgatgaccaggtgccggggattactgggttggtgactagcctcttgctttcggtacgctacacgcccaaccgcggggtcagtttcgatcagaacatgatgagctacggctcgctgttagggggcttactcgttggttacttagtcggtcaaatctttcgctggttagggaaaaagaaccggctcaaacccggtcaaccaattcacacggtcgacattgaagagcaagtggccgcctacacccggccaatcttagtcattatgcttggcgctttagcgattaactttgtcttaaacctcgtgtcttattattcttcttacacccaagcggcggcgttgatgcaaagtctgagttcgggtaacacacccttttggctcgagctcttgatggtttgcctgacgactttgctggagtggttagggattagcggctcttacaacttccagctgggaactgacagcacggaggcgatggcgaacctaaattacgccttggcgcaccacaccgcatacggggtgccgtatccttaccttggctcttctctttacaactcctttgccaattttgggggaatcgggctcgcgttggccctgttacttgcaatggcgattgtggcccacagttataacgaacaacggatggtgcgggccaacttcttaccggtgctgtttaacaggaacacggggctaatggtcggcttgccggttcttttaaatccgctctacatcttgccggcggtctttttgccaatggtcaacattttaattgcggcctttgccatcttcattcacttaatcccgaccccggtttactgggtgccggatgggacgccggggccgttggtggcttacgttggtagtaacggtaatttcgttaccttactcttcacccttgccctgcttgcctttgacgtttgggtctacatcccctttgttcggctttccctggccgtggaggggcggatccgcgaaatcgatgcaaaggaggaccacaaagatgtttaaactaactaaccgtcagcaacggcggagcctgtgggtgttgttagtggggatcttgttgctagtggtccttttgattcccaccaccagttgggttaagagtagcacgaaggaaaaagcagcccagcacaattcccaactgtcccccttaattatgattcctggttcgtcggccactaaaaatcgttttgacaccctggttaagctcttaaaccaggggagcgctactaaacactccttgttaaaagtcgaagtttacaattccggcaagatcacgtacactgggaaaattcggcgcggtgatacggaaccgatcatcgtggtagcctttgaaaataaccacgatggttactccaatatcaaaaaacaggctaagatgtttaacgaggctttcgaacagctggtccaaacctataagttcaataacttcaaggcctttggtcactctaacggggggttaatttggacggtctggttagaaaagtattacgacgaagctgacggggccaagattaagaccttgatgaccttggggaccccgtataacttttcggaaagctcggtttccaataaaactcaaatgttaagtgacctgattgccgatcgggagaggatccccagttccctaacggtgttatcagtgatgggaacgaagacctacaactccgacggcttggtgccggaggggagtgtggaagctggtaagtacatctaccaaaaggtggttaagcactatacgacgatgacggtcaccggaaacgacgcccaacattccgacctgccccaaaaccaacaaatcgtttccctgattaaggaatacatcttgaaccaaaatggcaatcggccgggcagcaaaaaccgcagtaaccggcaaaaccagttgagtagcaactaagcacgagaaaggatgatacgatgattaagaaactctccgcttgcactagtattttgattgggaagaaagcgacgattgacggcacgatcataattggccgtaacgaagatgcgaaggcggcctggcccaaacgggtggaaattcacccccgcgatagcatggaacgcctctttatttccaaagaaacgaagctgaccttgcaactaccggcccacagcgctcaatacatggcgaccccggagtggaccgataaggacgggctctttgaagaggacggcattaacgagtatgacgtggcgatgtcagccaccgagagcgcctacaccaatgaactggtgctgggatacgacccgctggtggaaaacggccttaacgaagaggcaatgatcacggtcgtcctcccctacgtaaaaacggcacgggaaggggtggcccgccttggtcagttaattgccgagcacgggactggagaaaccaacggggtcctctttgccgataacgatgaagcctggtactttgaaacgggtggcggtcactactgggttgcccaacggatccccgatgacgcctatgcggtggtcggcaaccaactggcaattcaagaagttgactttaacgacccggataactttatgttccaccccggaattcaggcgtttgtgtccgaacaccacttgaaccctcatgaagagggctttaacttccgggaaatttttggcactcacgaccgggccgatgccatctactccaccccgcgggtctggtacggtcaccaactgttctcgaagtctaaggcccaagccgaacaaccagaagaccaggacctaccatttttgatgcaaccggatcgtaaactgagcattttggacgcccaacgctacctggcctcccactaccaaggaacgccgtttgatccggtggggcgcgggagccaagaggaaaagcaccgctaccggccaatttcgttagccaagacccaggagtcacacctgttgcagatgaatcgtggcggcgccaatattcattggttggcactgggggttgcggcccaaagcgtttacgtacccttctttgccgggattgatgacgtgccgtccccatacaagcgcggtaagttgcccgcccaacgcaactccgcttactggatttataaggaggcgggcgtcttagtcgacagccactatcacgatttcttacctgacctgcaggcggttcaaaaagaacttaacgttaacgccgtcaaaatggttgcccaaacggatgctcacttaaaggagctgaaaacggcaacggagcgggcaaactacttaacccgccaaagtatcaactttgcgaccgacgccctcaatgcctaccgggacctatcactaagtttactgaccaaaatgacggattacagcccgcttaactttaagactgacgaaaacctttagtgacggtcacccgtccctagctacggaccgagtgattgatgtgacaaagctaatctaaagcagaaccggatatttcccgggtgatcattaatggcggaggggatgaatatggaaagtttggtaatggcagtgagtgcggtaagtagccagcccctgtcaatgtttattgtgattttagcggccctcttaatccccatcttgatggcccgctttcaaattactggggtcccaaccgcggtggctgagatcatcgtaggggtgatcttgggtaagagcggcttgcaagtggttaacacgaccaccaacctgagcctcttgtcatcggtgggggtgatcgtgttaatgtttttgtcggggatggagatcgatttttccctgttccggccggaaaaaagcaagggtgccaatcacgaggcctcaccagtcaagttggcggtggaggccttcatggtcagtttgatcgtggcgtttggcttggctttagggctacgaaaattggggctctttagcgacgtcttcttagcaacgatcatcttcaccacgatcgccttaggggtggtgattgccaccctaaaggaaaaggagatcctcagtaaaccaatcggccaaacgattttgttaaccgcggtgttgggggaaatagtaccgttggtcttgctgacggtgtacgcttccgttcgcgggggtgatgcgaccaaaatctggttgattgtgatcccgttagtagtggcggttattttgttacaccggtttcaccgccacttcggttggtttaaccgggtcaccaaggcgaccacccagttggatatccggttggcggtgttcttaattttcaccctggtcctggttgccgaggcggtgggggccgaaaacatcctgggcgcctttttagccgggatggtaatgaagttattagagccctatgaatcaacccaagacaagcttacctcgattgggtatggttttttcatcccgatctttttcatcatgactggggctaagttaaacctacgtgaactgttggttaatccccacgccctgatgttaattccgattttagtggccgggttggtcatcgctaaattggggacctttttagtctaccggcagcggtttggcaaccgaaattcctttgccgggacttttttgaccgttaccacgattaccttggtgctgccatcgctggaggtagctaaaaacctaggttcgatcacccaaacccagtctgatgccttcgttttggcggcggtgatcgtctgcatctttgccccggtggtcttcaatagtaccttccgcttggcaaaggcggaccggatcaagcaacgggtcgtcataattggggctaacgttatgacgatcccaatcgcccagcaattagaacgcaattggtacgacgtccgggtggtcaccgatgatcaagatagttaccacacctacgattccgaactgcaaaacatttactaccttgaacaactcaaccttgcgaccctgaagcaatccggctttttgacgaccgacatcttggtgattggccagcaaaaagaggagcgtaaccaagtgctcgccttgggggccaaggaagcgggggttgaccgggtcatcgccaatcagtcttcgatgcggacggctaatgagcagactcaagccctagttgaggcgggggtcgaaatttttaatacttacaacgtgcaggcgtcggtcttacgggccctgatcgagtcaccgtcaatcatgcaactgttgaccggcaccgaggccggcctatttgaagtccgggtgaagaatcaccgttacagtggcatccaactgatggacttgccaatgattgaccaaatcacgatcagccggatccgtcgtaacgggacttggttgaccccccatggcacaacggtgatcgagtatggtgaccggattatctttaccgcgaaggatagggacgtggtggccaacctgcgcgatgaatttgcccgcccaaactaagctcaattgaaggcgacggctggctatgttaaaatcaaaacaagcaattaaggaggccaaacgaatgccattagtacacatcgacctgattgaaggacgtagcgaagaacaattaaaggggttagtgaaggacgttacggctgccatcgctaagaacgccaacgtaccggaagaacggatccacattgtcttaaacgaaatgcggcccgaccgttacagtgttgccggcaagatggctagcgacaagtaaagacccgggggttccgttatgcggagccctttttttcttgttacctacctagaaaggatgaacgagcgtgaatgagcaacaatatgtgatggccattgatgaggggacgacctcctcacgggcgattattttcgaccacgcgggtaaagaagtggcgattgcgcaaaaggaattccgtcagtacttcccccagcccggctgggtcgaacatgacgccgaagagatctgggatagcgttcaatcggtgatttcagaggcggtcatcaaggcgcaagttaagccctaccggattgtggcgatcggaattactaaccagcgggaaaccacggtgatttgggaccggaagaccggtaaaccaatcgcccgggcgatagtgtggcaatcaaagcagaccgccccgattgctgaacgactaatcgaggagggctacacggaccagatccaccaaaagaccggcttagtcattgattcctacttctcggccaccaagatcaagtggcttttggataacgtaccgggggcccgggagcgggctaaacgaggcgacctactctttggcaccatcgatacctggctcttgtggaatttaactagcgggcgggtgcacgctacggacgttaccaacgccagccggacgatgctctttaacatccacacccttgactgggaccaagacattttagacctgctcgatattccccgggaaattttaccggaggtcaagccgtcctcgcacgtctatggttacacggccgattaccacttcttcggggtccaagttccggtcgccgggatcgccggggaccaacaggcggccctctttggccagggcgcctttgaaaaggggagcgtcaagaatacgtacgggaccggggccttcacggtcatgaacaccgggacgacgccaatgctttcgcaaaatggcctcctgacgacggtcgcctatgggattggcaacgaggtacattacggcctggaagggtcgattttcgtagcgggctcggcggttcagtggctccgcgatgggctacggctctttaagtcggccggggagtctgagcaaatggccgttgatgcccagaccaccggtggcgtgtatgtggtgccatcctttaccggtttgggggcgccctactgggatcaagaggtccgcggggctatgtttggcctcacccgggggagtagccgggaaaatattgtccgggccaccttggaggcaatcgcctaccagaccaaggacgttgtggacacgatggtcaaagacaccaatttaccgttgaccaccctggcggtggatggcggggcgtcgcgcaataacttcatgatgcagttccaagccgacctcttacaaacgccgattgtccgtgcccaaattgaagaaaccacggcgctaggggccgccttcttggctgggttggcggtggacttctgggaggatcaaaacgagctcaagcagttggctaagtcgggtgaccgttttgacccggttatgaccaaagaagaggctgggcgtcactacgccggatggcaacgagccgtagatgccgttcgctactttagccacggtgctgaggaatgatccgggtaacggtacggcaagtccggcagcttgctggtagaattcaggcgatcattgatcacaaccacctagcgggactgatggtcacggagaactttttgctggcactaatggcgagctggcagccggtcgtaaccgacttaacaaccaccgggcgagttccgcaccaacaagttgcttactggcgcggggttagtcggtgggtgacgcaagtagaaacccacccggagtgggtgcttgaaatggaaccctatacctcagtggtggcccagcaagcggcttgccaatgcatccacgcctgtcaagcccaggcgctagctaacccgctggcggatgcacaagtgggagtggtgcaagctcaattagctaagtttgacctgcacacccaatcggtgggggagctagcgatgatccgccagtactggcaagcgacaggtgaataaaacaggagtgagtggccaaccacctccttggcaggccgttagactaagctagggtgcaggttagcgcaagaacgcggtgttcttcgcccgtacttaggcactaggcctgcggttggttgccacgttacctgtctaacattcatgaatacaataagaggtcgggaaaacatcttttcccgacctcatttttttagttctgaagcttatttcccacccagctattccttgggtttttggtggtagacggcccgctggttgaccattggggcggcccggcggttcaagagaatggggaccttttcaaccgtcacctgggagaattcaaggccaaaccactgaaccggggtggtggagtggttttggataaagatccgcgccccgattaagaggtgttgccagccccggagctgggtactagacgatagctggtcttggatgatcacaaagcggaagtcgccgacctggcgtccgggggtggtagtgtacttttgcggctgcgggtcgatgatcccttggcgcatcaggtcattaactacttgacgcaggtacaagggaacatggtggttcatcttaaagcctaggtaaagttgcaagttgacgatgttgcgggtgcccatcatgtcgacggtgtagtaattggtgtagggttcactggtggtgttgaccgtcacaaaccagtagaccttagcccgcttgggggtcttgtctagaatcgagtagaggacctcacgcttgatggcgtcgccgtctctgaccttggtaagcatgaccaagttggagatgtacaggggaattgcttcatcatcggttagctcttggagggtccgtttgtaatcgcccaggtgggtccacgccgtttcaccatccaagaagtcgcggagcttgttgccaaagtaccaggccaccatgatggcaacgatcaccagggtgatgaagagggtcacgtagcccccgtggtcaaacttggttaaagaggaaaccaggaagatgatttcgatgacggcgtagaggcaagtaaaggggagggcgaaccagtggtggcgccggctagctagatattggtagagcaagagggtcgtcatgaacatggtgatcgtgatggcgagcccgtaggcggcctccatgtgctcagaggtccggaagtaaaataggaccagggttgtgcaggcgcacagtagccagttgatcgtccggatgtagatctgaccacgcgacaaggacgggtggatgatcgccatcttcggcaagagcttgagcccaattgcctcttccaccagggtaaaggagccggtgatcagggcctgggaagcgataatggcggcgatggtggcgatggcaaccccaaataagtaggcccaggatggcagcatttcgtaaaaggggttaaaggccgaactagtggtggtaaagtggcccaggttatggatcaaataggccccctgaccaaagtaattgagggttaaagtcaaaaagacgaagggccaggtgatgtagatggcttggcgcccgacgtggcccatgtccgaatagagggcttcagccccggtcgtcgccagaaagatggagccgaggatgaagatcccgaccttgttttccggcgaaaagaggagcattaaaccatagtggggggagagggcgcgtaccaccagcggttctttaatcaagttggcgatcccaaagacccccaaaaaggagaaccaaatcagcatcaggggcccgaagcccttgccgatcaagacggtcccgaagcgctgaattaaaaagaggattaacaggatcgtaaaagtgacccagataaccgtggtttgactgttaatcggggtagccggaccaagcgcaacccccttgaggccttcaatggctgtggtcaccgtcacggccggggttagggtaccgtcggccagcagggcggcaccaccaaggagggccgggtagattaaccacttacggcgcttacgaacgaggtcgtagagggcgaagatccccccttcaccatggttatcggcccgtaaggcgaccaagacgtacttaatggtcgtcattaacattagggtccaaaagacgagggagaggcaaccaatgatgtagtcttcgctaagtttgttgagaccgccagcatcgttaatcagggcggtcattacgtaaagtggcgacgttccaatgtcgccgtaaacgatcccaatggtgatcagccccatcagggcgagatttttctttccttgctgcatgacaattccctttcgtttcccggtaaatagccgggttgattactattattttaatccaatttgccagggctgataagaaaagcccttcttgcgctataatggtggcaaattaacgaaatcaatcatatgctaagcgggaccaaagtacaatcagaaaggggaaattggggtggaaattattttagaaaaaacaaccaagcccttctttaaaaagcacgctggcagtcaagacctagctaaggaacgcattggggcaatcttggaacgggagcaagcgactgggctgacaaaggtcaagttagccctccaccagccagtggccgggcgcccctgctttgagctccgctgcaacctggctaaactcggttcagtccgggtggccttcatcctagacggccaggtggcgcggatctggtttatttctactagtttacaaaaggccaccttcaccagcgaagtgagccgggtattgcgggaggtcagcaaatgaagagtattaacgtcaagcaggccgaacgcctggtgaaggcgttcggccaaagcgggaccggtcactaaggtcaccctgttaacccgcaagaaggatcgccaactaacgatcgagcgggggacggcggccgtagtgatcgacgagcggggattttacaccggacaaatctcccttaaccttagcgatggtcaagcaaaacacgccctactacaagcctttaaacgcgagttcccccgtagccaccagctatacttacatcaggaaaaagattagcaaggaaaagaactggccaagtgccccgttcgtaaacgattcttaactagttttttagttaagattcccccagccgttatggcatgcggtaaaatgaaggggttatgaattttttgaagtaggtataattatggacttttcttttcgccgccgcccacttggcactctgtatcttaaatacaccctgatgtttggcctaattgccctggcaatgtttgggggctacgtggtgaccggccacaccctgatttggaacacggatgccttaaaccagcacctcccactgatggctaagtaccgggagatcgtacttaactggctccaccaccccttttcaagtcaccaagcctggtcttggcaaatggggatcggcaccgatacctttcaggtttattcttattacacgattggcgacgttttcgcttacttggccctcctatttccggcggccaagattaccttggcctaccaggtcatcatcgtcttgcggatgtattgcgttggtttggccttcatttactttgcccagcacttcgacttttctgaccgggtcatcctggcgggaacggcggtgtacatggttaactcttaccttttgtatgtggccgttgcccagccaatgtttaccaccaccttcatgctctttcctctgttggtcatccaagtggaacgggtcttaaagggggggagtgcttggcccttgaccggggccttcttgtggatgctggtggctaactactacctcgccttcgtggtgggggtggggacgatcatttacttggtcttacgggtggccactcactaccgccgtgccctcgactacggaaagaccttgcttaagctagtctttgcaaccgtgacctccattttgttagcggcggtcttattagttccagagctactggcggttcaaaactcgacccgggcgggggccgagttcgctaacggcctgaagacctatccgctgtactactacctctttttacctaagcaattaattaacggtggggacacgaccttcatgttctggtcggcgctgggactggcggcaatcgtcttcttagccatcgtctacgtctacacccgtccccggcaataccccctgctggccatcagtttggccctttccttggtgatgctcctgattccagcctgcggggcctttttcaacgggatgatgtcggcttccaaccggtggacgctcctaatttacttaccactggcgatgacggtctgcgtcttattgcaaaatgtccccacgttagaccaaagaaccctcaggattatgatactggccaccgggggctacctgctagttctgttggcgacctactttttccaaaatgatgatgacctctttgtgccggtcatcttcttgttggtgtccctgatgattatttcccgggcaattggtcacccggggccggggagcgaacgctggctattaggggtaatcttagctaacgtctgctttaacgccctgtacgctgccttaccctataacggtggctttgccaatgacatgctcacccggggccagtaccaggcaattaccagccagcgctacgggggcctaaatcagggcctggcacaaaagtctttttaccgggtcaacacgatctccaataatgacatcatcaattcgttgaagatgtacaacgatttgaccagtggcttgaacgccgttaagtcttactattcacttcaaaacaagtacgtcggggcgttctcacggtcactgggtaacgtgcagtaccaatctaacattccgctcaaccaactcgacgatcggacggtcctaaacaacttcttgggggtcaagtacctcttcgtccagtctaatggcgataacgccaccaagattccggccggttacaccctggataaaaccacgacgcccatcatcaattacgaccaggggcaaccaagcaatgccaagacggcggcggatctaacgacgattcagaccagccgctatacgaccaaaaacgccttcccgctcttgtattggcaagacaccgccatcagccaagcgacctaccgtaagttatcggcgacccaaaaggagcgggccttggcaagtggggtggtggtggcgggtaaccaagtcgccattaaggggttaaagaaggccaacctcgctggggaggttaagaagttaactgccaccttgatttctaaccgcttaaccccggtcaaggctagccagttggttcaaaccgacccagatgaaacctatcgcttgaccttcccggacctgactaaaaaggccgtggctaaagctaccaaggggagtgagttgcacgttgacgtttcatccattaagttcacccccttcagtatgaaagaagagcttgcttacgaggcggcccacgatcagtacatgctgaccaacccgggctcaacgtataacgctaagtttgcccgctaccaaaattggcgtaagctagtcctaaagggggctcccgataagtcgtttacgattacgctcacttcttcaaagggggaagagacaatcacccaacccaagcagtcaatcctctcgttctttaagttagtaacggatggctctttgaacttagggtactttggtggtcagcttccccaaagtgtcggcgttaccttcagtaagctaggaacctaccggctaaagtatacggttgaagccgaaaagttgggtaaacagtatgatcaacaagttaaaaccattcaaagccacgccctaaaggaccttactttcaagactaaccaggtgtcagggacgatcacgacgaaccggactgggattttaacttcgtcaatcccttattcgagcggctggacggccaccgttaacggaaaggcggttaagttgctacgtactaaccaggccttcgtggggcttcggcttccagcgggacaccaccgcgttgttttacgctatcacgtaccaggactgacgctgggggcgaaggttagcttggtagggcttgggtggaccctaatggcagccttggccaccctagtgttcaaacggcgtcgagccaagtaaggactggagataacgtcaaaattgccgctaattggcagttcttaaccgatcaccatggtccctcgggaaaagcggctggccaatgtggtggattgggcttgctaagcctactgtgtaacattcaaagtttttaaaaggggccgggagaaattttctcctggcccctttttaggtttaagtatcgttattgatctgacttgagccagttactaaggtagtcgcgaagtgcgatggcttcgtccttggtaatggaataggtagcgtcaacttggtcttgaccagtgacggcttggttcgatagtaacaagaagagttggtggtcccgggggacgattgacatttcgttggccaggccgtcgtcatctaattcatcgttatagcgaacgtcaaaccacttaccatcagttgttaatttacgcaccttttaatcctcccaatgatcaaaaaaatcaggttcccaatgtagggtccctgatataaatcatagttaattcttagcactttcgtcaagtttaattgagtggccccgttggcgatccttaagttggaaggaaacaatgaaggcgacgataattaaggcaatcgtaaagtaaaaaccggtgtggcttcccgccgtaaagcgggcggcggcggaaccggtggctgctccacgacccaattccaagaaggaagtggcaaaggcagttgctaaagcacctacgacttgttgcatcgtgttgagaattgtagatccatcaccagcttcccgtccggacagggagttcagagcggaggtttgggcgggcgacattgctaaaggcgccccgatcattaagattacgtgagcggcgatgatataaacaatgcttgcggtatcggaagccatggctaacataacggcccctataaaggcgatgataaaaccgagaatggcgggccgacgtgcaccaatgttatcgtataaccgaccggcaattgcggaggtcacggcgttgatcaccccaccaggaagcatgatcaccccagttaaggcaacggcaattcccaccccgttttgaatgtattgtggcatcaggtacattgcagacaggatgattgcgaagtccagcattaccaagatggtcccaacggtgaattctttgttctttaagaccttcaggtttagaattggtgattctaacgttagttgacggtgtacataaaggaataagacgacaaggccaattactaaactaacaattacctgccagctagcccaaccgtaacggctagaaaggctcgccccagcaacaatcccggaaaaaccgatgattgattcgatgattgataatacgtcaacacgcggcttgctgatgtgaccgacgttttccagttccatgaccgcaaaaattaaggcaatcacgagcaggggaatgaaggaccagaagatccaacgccaatttgcaatccctaagatcaacccggttaaggttggcccaatggcgggagcaaacatgattaccaatgccatgatcccgtttacggcccctaatttttggggtgggaagatttgcatcgcaacggcgaacattagcggcaaaataagcccggtcccgatcccttggatcatacgcccggttaataggagggcaaagcctggggccatggccgaaagtacactccctaaaataaagaccaataaggcaaagatgatgattttacgcgttgaaaaccactttgagatgattgatgaaaggggcatgatgatcccaataatcagcatgtaacccgttactaaccattgcaaagtggcagtcgacatgttaaaggcaatgctcaactttggtaaggcaatgttgagggacgtttctgaaaacatcccgacaaaggcgccgagaagcatcgaaaccatggcaagcttagggtgccgaacccggcttgctgaggtggtacgtggatgggcttgttccatttgaactttttccataaattaatttacaactccttctcttgatttcacaattgaatacattaccatatttttttagcctcgtaagttaaaagtttctcatctttaagaaaatctttaccaactaattaatgccccctatgcattattgttgccttaaaacgggcatttgacaacgatgaaaccgttaacgataatttagagaaagaagttgttttttcataaaataacggcgatttaagtttttatacaagtgagtggaggagaagttaggatgaaaaataataaaaatcggcgcatggtaataatgattgccataatttgtgtcttagcgctagcggggacctggctagtccgggcccaagctaggcaattaaattcaacaaaatatgttcaatcaacgacgcccacgctctttttccacggctatggctccagcgccaacgccgaagatcacatggccaaagcggcgcaaaaagccggggtaaccaagacgatcatccgcgctaacgtcactaagcaggggacggttaacctagtggggacgatcaaaaagggggccatcaacccaattgtcgaagtcaacttcgccgacaaccgtaaccccgactaccaagtagacgctcgctacgctaaaaacgtggttgttgcccttcaagagaggtacggttttaaggagatgaacatggttggccactcgatggggaacatggcgattaccttttacctggttaataatgccaacgataagaaacttccccagctaaaaaaacaggtagacattgccggtcacttcgacgggattcttggttacgaccaaccggcgggcttgtctatcaaccaaaagacgggggagcctaacaagatgacggacagctttaaggagcttttgaagttgcgccaagtctacccacgccaagcggcggtcctcaacctgtacggcgacatcggtaacggcagcgacggccgcgttgccaacatttccagtgagacgcttaagtacctggtgagcggccgggccaagtcataccaagcccaccgttttactggtaagcaagcacaacactccaaactgcatagcaacgcccaggtcgaccgctacctgatcgacttcttatggagaaaataggagtgagtgcgccccaacctactcgacgggccgttgattaagtgagggaagctaaaaaagctgaagacggcgtcgtctccagctttttttcttatcatttattcggggcggtagttagcggccaaaaaatcagccattgacgtgggggcgtggccggtgatggtccaaaagtcatcactagttccgctcaacaggcccatggcaccagcttggtacatcgaggccagttcgtcaccatccccttcttctcggtataaccgggcgaactcagcaaccgaaaccggctggtaaccaattcggtggccgctaaccttagtcatgatggcggctagttcggtcattgggaggctggttgactggctaaggaggtaggtttggtggtgatcccgcagggcgggggttaaggcgaccttagcgattgcctcggcggagttttcctgggaaataaaagacattggttggtcgccaaccgggtaaataacgttctgccgttcaatcagttccggtaggtaaggaaccagtgggtcggcgtagaggctgtttttgatgacggcgtagttaagcccactcccggctaagcggggaggtaagtaggcgtaaaagggcgccatccggaaggggttattggcttgatcggtaaaaaaagagaccgcgacgatggaagggacgttagcgatccttgatcgccgttaacaggttctccagttccgttacccggccggtcaaactgtaggttaacgacgggacgtaaacgaccacgtcgctcccggccagggcgggagtcagggtagcgggatcttggtagtctaagtgggcaacctgaaagccagcttcctttagagcggcggctttgctagggttgtgggcgccaatccgaatttgattgggcgaaagagttttgcttagttgatggacaatccggcgacccaggtggccggttgccccggtgacggtaatcaacataaaaatccctcctttgtgtaactttaattgtaacacattggaggggcttggggttagccttggttggtgaggtagtcttctaggacggccaagacaccgtcgtggttgttgtcgagggccgtacggtggttagctgcggcgatggcaaccgggccggcgtttttcattgcgtacccaaacttagtgagcttgagcatctcggcgtcgttaccgccgtcaccaaaggcgatcaggtcggcaccggaaaggccccaagaggagagcaagtcgttgagggcggtcgccttgttaatccccgggacggttacgtcaacggagccgttaccactcggggtaatccgaacttgattgccaaagcggtcctgtagggcggccaattgttcgtcaaccttagctgggtccagtaaaaaggagagctgatagtagcgatcggccggcaggtccttgtaatcgtcgaccagtacgtggttggggaagtaaaattgttggcgcttaagggtcgtggcggggagtttagcgtaaacgtagccgtgcttaaccccggagagggaaggggtgagcttcaagtcattacacaagaaccgaatcacctcgtcagcgacggcttgctcaaccgtggtctgcaccagatcttggccttggtagaccacgtgggcgccgttttcggacacgaagtagaggcgctccttagtgtccgggaagtaattggtgaggcactcgtattggttgccagacgacacgattaccttgaccccctggtcctcaagttgggataagatacgttcaaaacgggcgtggtcgtagctcttatcgtcgtggacgaaggtagcgtccatatcaaaggtgactgcctgaaacggtaatgacattgaaattcctcctttaataacaaaaaatggcgatcacgaaaccgtgaccgccatactattgggctagctgggttcgaaccagcgcatgacggtaccaaaaaccgttgccttaccacttggctatagcccaattaaattacttaattatcttacccggagtcgttctaaaatgcaagtgattttggtgaatttcttggtatttttttcttggaagcgttcaactaagcccattctcttgacccaatatgcaatggttgtataattgaacctattgttaataattatacattcagatgggagatatctaatggatcgacaaacggatacggccttctttggccaaccgcgggggctttcgaccctctttttcaccgtcatgtgggaacggttttcctactacgggatgcgggcaatcctacttttttacatgtattacgccgttactaagggcggcctgggaattaaccagactacggctgcctcgattatgtcaatttatggctccttagtctacatttcgacgattgtcgggggctggctggccgaccgggtctggggaacgcgccggaccgtttttttagggggcttttccatcatgctgggccacatctgcctctccttgccctttggggtgagcgccctgtatggttcaattgtcttcattgtgattgggtcggggctgttaaacccgtccgcttcgtcaatggtcggggacttgtatgcggaaaacgaccggcgccgtgacgctggtttttcgatgtttgttttcgggatcaacctgggggccgtcgttgccccgtgggcggtgccgtgggccgctggcggctttggtctccacctctttggtagcgagcaaaactttcacgccggcttcgccctagcggcgattgggatgttctttggcttgctccaatacatttgggacggtaaaaagtacttacccgaaggtagcctgaccccggacgatccgctgacagaagcggagaaaaagacggtaatcaagtgggcgacggtgatcgtcatcgccttagtggcggtcctggggctcatggctgtcttccacagcttcaacgttaacggtgtcatcaacttaatcacggtgatcgccattgccatgccaatcgtttacttcgtaatgatgctgcactcaaagaaggtcactaagttagaacgcaagcgggtggttgcctacatcccgctcttcattgccgccgccatcttctgggggattgaagagtccggttccgtggtcttggccctctttgccgagcaacggacggtcttgcacatcggggggtggtactttaccgccgctaacttccaaaccttaaacccactctttatcatgctactgacgccggtcttcgtcctcttatgggaccactggaaaaagcaaccgacttcaccggggaagttcgcttgggcgttggtcttttccgggttatcctacgtttggatggcaattccggggatgctctttggaacggccggccgggtttcaccgctgtggctggtcggttcctggttcttagtcgaaattggggaaatgctgaactcgccaattggcttgtcggtaacgaccaagttggcccctaaggccttcaagtctcaaatgatgagtttatggtacatggccgattcagttggccaagccgtcaacgcccaaatcgttaagtactactcatcggcgaccgaagtaccgtacttcatcgccgtgggggtcgtttcgattgcctttgggatcatcatgatgttcttcgttaaacggatccacaacttaatgggtggcgttgattaggcaaaaacgactagttgattagttgcgctcaggtaaccagtctagcaattttgccacgttaatattcattaatttaaaggggaccgctctggtgagggtggtcccttttttgcgtgtaattaggggggaaagacgtgacgcactaaacaaaggtggtgcggaaaccaaccaacagctggcggtgtgtcgaccggagtactccttgcgaataattagaataaaataataagaattgatccttgacgagattaaatgagaatgttttaatgtagttatcaacttgaaggaggaacaccaccatgaatcaattaacccaccttacgaacagctatttttcctttgcttatttcgaatagcgtccgcaccgcttaggtccggacgacgacgttcagacctaagcaagggtttttggtacttccttgctagggcagtctagcaaggaatggtggcgacatctctcactttcatttcctttggtgattaccggctagactgagcaacgtcttagtttagccggtttttttatacctttggaggaatgaacatggaatctaatttaaccgtcaaggcacccaccattcaccgggcccgcttggcctggtcgctgtacatcaactacttcattcacgggttcgggctaattatcttggcccagaacatgactagcctgggggcggcttggaacagccccctgaaaattgtctcctttgttatttcaggagttgggatcgggcgcctcttgtcctacctgattaccgggtttttagctgacttatttagccgtaaggcctttgtcttactggggatgagcgcctacctagcctttgcgatcggaatccccttcagccacaacatttacgtcgcctacttcttcgcgatcctggccgggattgccaactcggccctcgatgccggcacctacaccaccttcgttgaactaaacggcggtaacggcgcggccacgatcttaatcaagactttcatgtcggctggcgagttcgtcttgccactgctcatcgcccaactaacggccaacgggctatggtttggctggtcctttatgaccatggccgccctggtggtcatcaacttcgtcttgatcttgcccctgtccttccccctgcctaaccaaagtccggcccaagaaggcagcggagaaaaaaaggttaaaccaaactgggtgaccacgatcgctttggtcttatacgggtacacctccatggcggtgatgatctggtttacccagtggatctccctctttgccgctgacagcttgaacttttccgacggtcaggcccactttctcttgtcgctttacagcctgggttcgatcagcggggtaatgttgatctttgccctcttaaaacgcaacgtcaaggagacccacctgttgattagcatgaacgtgattgccgtcctcgccttgttaggggtcctggttggcaccagtaccgtgatggtgcaggtggctagcttcgtcttcgggattagtgccgccgggggaatcatgcaagtcggtttgaccctgttcatgcgcttcttcccgcaccaccgggggatggtcaccggggtgtactacttctttggtagcattgcttccttcaccgttccgctaattaccggggtcttgtcaaccactagcatgcgggcggcgatgaccggtgacctagtggtggggttaatcggtagcgccctgatgctcgtcgttttgattagcgaaagggggcgtcaccatggctgagttagagcagctccgtaaccagatcaaccaagtcgacgaacggctcgtcgcccttttaaagcaaaggtttgaaatcgttgaggcggttgcccgcacgaagcaagcaagcggggcgccggtctttgatccaacccgggaacgggcggtattgaagcgggtggtcgacctagtggcaaacgaggattaccaacccgccgtagcgcaagtttttaccacgatcatggatcaagccaagcaactagaaaggaaaaaattatgttaacttacctcacggccggtgaatcacacggcccccaaggaaccgcgattattgaaggaattccggccggtctagccattgacgtggaccaaatcaacgccgatttggcaagccgccaaggtgggtatggccggggcagtcggcaacagattgaacacgaccaggttgagattctgggtggggtccgccacggccttaccctagggtcaccgatcaccctcgtggtgaaaaatcgtgaccacgcccattggtcgtcgatcatgcacccaaccagcccagccaccgcggaaaacaccctacgcaaggtggagcggccccggcccggccacgccgacctggtgggggggatgaagtaccgtcaccgcgacctgcgcaacgtcttggaacgttcttcggcccgcgagacggcgatccgggtggcggttggcaacgtctgtgaacaactactggccgccttgggggtgaccttggtcggctacgtccaagcaatcggcccggtcgacaccgacctaactaagccccaaacggtgagtgaaattaaagacgccatcacccaaaacgacctgcggatccttgctcaagaccgggtagcggaacttcacgacctaattgaccagacccggcgtgcgggcgatactctgggcggttggatccgggtggtcgttaacgggatgccggccggtatcgggagctacgtttcctgggataccaagctagatggtcagttggccgccgccgtgatgggggtcaacgccatgaagggggttagcattggcgacggctttgagatcagtcgccaccccggcagtcaggggatggacgagattagccacgacgccgatggctaccaccgtttatccaaccacctcgggggcttggaaggtgggatgaccaacgggatgcccctgattattaacgcggccatgaagccgatcccgaccctttacaaggcactcaagacggttaacgtggtgaccaaggaagtggaaaaggccagcgtcgagcgttccgacactaccgcgatcgtgccggcttcaatcgtgattgaaaacgtggtcgccatcgaattagccaaggccttgactaacagctttaacgctgacaacctggcccggctacaagaacagttagcggcctatcgagaagaactgcggggttattaatatgaagattcacaccttagggccggcggtaaccgattcttaccgggccgccgagcaataccgggctgaccacgaaaatcttgaggtggttggccaccccagttttgaagtgctctaccagtcaatcccggaactaaggggtgaattattattaattcccgcggcggtcaaaacgccaaccggggccagttggggggacctgcactaccaatacggtgaccggttggagctaatcgacagcctaatcaccgaactttccccgttggccattttggaacggcgggggcgaagcggtcaacgggcctattgccacccggccacgattgattacttaacgagaaacgttgagggtcccttggaaattatgccctacccgagcaagtggcaggcttaccggtgctatcaaacagacgggcggtataccctgaccagccaggcctttgccgggccggccgaccgggtaatcaaaaccattcacttaaagatgctgtggagcgtgtaccaagttaagggagaaacggatgcaaaaacgagcgttaacaattaatagccggggcctgaacggggaactggcggtgcctggtgacaagagcatttcccatcgcgccctgatgatcggggcgttaagtgaggggaccacggtgattgatcactttttggcgggggaggattgcttgagcactttacgggccctgcaagaccttggcgtcgagatcgagcgaaaaggggagcacgtcgaagtaattggacggggaatcgccggcctggttgaaccggcggcgccccttcaaatgaataactcggggacctccacccgtcttttgatggggatcttggcgggccagtccttcactagccaactggtgggggatgcctccttgagccggcgcccgatgaagcgggtacaaggaccgctggcccgcctgggggcgcaaataggcctgagtgaggcggggaccttgccggccaccgtggtggggcaccccctccagggcgcacgggtgaaattagaggtggcctcggcccaggtcaagagcgccgtgatcttggcggccctccaggctcaggggtcaacgacggtgagtgaaccactgccgacccgtgatcacaccgaacggctcttgaaggcctttggggcgaacttaaccgttgaccgggcggcgaactcgatcaccgtgacccccggggcgcgcttggttggccaagaggtcctggtccccggcgacccttcctcggcggccttcttcttggtggccggggcggtgatcgctaattcgcacctgacggttaaagacgtctgcctaaatcccacccggacggggctcatacgggtcctgaaaaaaatgggggcgcgcctttcaattaaagagacggctagcgggggcgagccgttaggggatgtgacaattcaaaccagccagttaagggcggtaacggtgaccgccaaggacgtaccggacttgattgacgaactaccgctagtggccctgctagcggcctgtgcagacggggtaagcgagattagcggggcgggcgaactgcgggtcaaggagaccgaccggattcaaacggtcgccgaactgttcttgcaactaggggtggacgtggaagaacgtccggatggttggcgaattgtcggccgccccaattggcaagttcaaaagccaaacttaaatagccacggcgaccaccgcctggggatgttagcggccgtggcggccctccgctcaacgacgccgctgttcttgattgacccggacgccgtggcggtctcttaccccagcttctttgccgacttagccaagttagggggtgcttaaatgactaccgtctttattcacggcctcggcctgatcgggggatccttgatcagggcgattcgggttagccatccccaggatcaaatcatcgctagcgatccgaaccaagccgcactggattacgccctgcaagtggggttggttgacgagacgaccactggcctcgcgggagcacaacgagcggactttatcatcttggccggtcccgtcttggcgatctgccaagacctggctgacctggcgagaatggaactgaaagagggggtggtggtgaccgacgtggggagtaccaagcaagcggtgctaaaagccgcccaaccgctagttgacgccggggtcgccttcgtgggcggtcacccaatggccggttcgcacaagagtggggtccaagccagtcggcgcgacctggtggaaaacgccttttacttcctggttcccaccggcccagttgaccgccgggccagtttaaaagacctgctgagtggaaccggggcaaagtggttgaccgtcactgccgaggagcacgattacttggtggcccaggttagccacctcccccacgtgattgcgacggccctggttaaccaaacggcgaccgcctttgcggggcaaccgctaggggaacgggtggcggccgggggctttaaatcggtgacccggatcgtcgcttcggatccgacaatgtgggcggcgatcatggcgaccaaccgtgatttgatctcccaacagttagccagttacctaagggagctgcaacgcttcaaggacctgattgataagcaagaccaagcggggctgtttgaaaccttttccaaggcccgggtacgccgcaaccgactcaaccaacaaagtaaggaccttttttacgacctcttcattaacattccggaccaggtgggggcgattgccggcgtcatgaaccgtttagcggcggccaacgtcaacgtcatccacttgcaagtgttggaactgcgggatgaaattaacggggtcttgcaactgaccttcagcacccccgccgatcaaaggcgggccgctggggtcctcaacgattacgaaatcattgaacggggggaccaagaatgaacttaatcctagttggcttcatgggtagcggcaagaccaccgtcagcaccctgcttggtgaggccttacagcagccagtctacgacctcgatgacgaagtggagaaggcagcttgcaagccgattccccaaatttttgcagacgacggcgaagcgagttttcgcgacctggagcacagcgcccttaaggaggtggttaagcggcgccagggaatcttagcgaccggtggcgggaccccagtggcggaacgtaaccaacgactgcttgaacacgcccaggccccggtaatcttgctgacggctagccccgccgagaccgcccggcggttaggggacggggaggggcgcccgctagcaagtaagctaaccccggcggagttagcggacctccaagacgcccgccgccccgcctacgatcgttgtgccgacctcaccattcgcacggataagctctcaccgacggcggtggccgagttgattatcgcctttttacggatccaccaagaccaaagtgcctaagggcgcttttttagtggtggggagaaaccatctttacgacaggggaaaggcaaatggtatcaacacgcataaaaatgcaatgattgccgcatttattaactatattacgtatatttacttgtttttcacccgggagtagggtacaattcccctaatgattaaaatttgaggagaaatagtatggacaagtcaattttgagtcaagcttcccaacacgaagagcgcaacattttagctgaggtctgcaacttagcggcggccagggacgacgtgatcgacctttccgtcggcgacccgaacttcgccaccccgctgcccattgttgaggcggccaccgaacgcgccaaaaaagggcacacccactacacggcggcgatggggatgccggagctgcgagaagcaattgcggaatactatcaaaaactaggggtacccgccaaagccgcccaggtgatggtgacggtgggtgcggaacatgccctcttgttggccctatacgccttactcgatccgggtgacgaggtcttgattgccgagccgtgcttttctccctacgccgcccaggtgaaactggccggtggggttccggtgatggtggccatggaccccgaggcgggctttgccattgacccggccaaactcgaagcggcgcttacagataaaactaaggcgatcatcgtcaactcgccgaataacccgaccggggcggtgcttgatcaagaagctgcccagggcctgggtcagttggcaattgaccacaacctgatcctcttgaccgatgaaatctacgccgacttccaaatgccgggtcaccactactacccattggctaaggaggctccggataatacggtcacgattagcgggatgtccaagtcctttgccatgaccggctggcggctggggtggttagtggggccaaagtatttagccgatgctacggcggcggtcaacgaaaacgtggcctacacggcgcccacgatcagccaagatgcggccctctatgcccttgaacaccatgatgaactggttgccccgctggtggcggccttccaagagcggctaacctatttacaaacggccctgggcgccttgccgaaccacgccgtgaatccggttggcgggtcgatctacgcctttttagacattcgtaagaccgggcttagttcggagcaatacgctacccggctcttgaaccaaaccgggattttagtggtgccaggcttggcctttggcaagggtggcgatggctttgtccgtgttgccgccactcagccaatggcgacccttaaagaagcggttgctaagtggcaaagctttgacccccaaaaggaggattaaaatgaagattttgatgtattcgatcttagacaccgaacgcccctacgtggaggcctgggtaaacaaaacaggccaccaagttaagatggtcgaagaggggttaaataaggagaccgctaagtgggccgcgggctttgacgggatcgattttcagcagaccaatgacctggatccggaggtctacgcgactctagaggggttaggaatcaagcagctgaccgcccggatggttgggtttgatatgattgatttaaagcaagcggccgaccaccacttactggtgaccaacgtcccggcctactcgccgcgggcgattgccgaaatggggctcacccaggccctgcgcctagtccggaaacttggttactacgaccagcgaatggataattacgactttcgttgggtggggctggagtcaactgagatctacaacctgaccgtgggggtaattggtgccggccacattggcggtgccaccgcccgcctgtacagcgccctgggggccaatgtcttggccaccgacccggttcaccatgcggaactagaggccgacttgacttacgtcgacctcgagacattgcttcgggaagctgacattgtaaccatccacaccccccttaatgaggaaacggcaaacctcctggatcgaacagcctttgccaagatgaaggatagcgcctacctgattaacatggcccggggcgggttggtcgatacggcggccctgatcgaggccctgcaaaaccaccaactggccggggcggccctcgacaccctcgccgacgaaacgggctactttgaacgccaagccagcagagaagaagtatcagaatcctatctgaccttgcgggcgatgcccaacgtcttgatttcaccgcactcggcctttttcaccgataccgcaatcaaaaacatcgttgaaatgggactcgatgacgtggttcggattgtcaacggtaagcgaccactctacccggttaattaaaaacacccccacttgcagttggtaagtgggggtgttttagttatgagctccgttttaacaggcgttggcacagcttggttaaggcacgccgggaggaaccggcggggagctggttgatttctgctttggctttcttggtgaaggcggtggctagttgacgggcttgctcgaccccgccgttttcaagcactaattgacggacgagctgcatatccgcttcactcattaaccgtcccttgtccaagaggggcttaaaggcggccgagttagcttgcatcgctaacagcaaggggagtgagtagacccccgtggccaggtcttctaggaccggcttgttgagttggtcgccgctggagtagtcgaggatatcgtctaagatctgaaaggcgatcccgacgttttggccgatccgcttggctagggcgacggtccgttggtcggcaccgccaaagtaggccccttcgctagctgccaaggagaagagggcggccgtcttaccgttgatgttgcgcaggtaggaaaggaaggtttggtcttgtttgaaacggtcggccatttggcccagttcaccgcttaagatccggtgcatgatctgggcgttggtggtcaaaaagggagttgtagcggtggtggtggtgatcaggtcaaagaagatcgtgaacaggtaatcgccggaataaaccgccacgtccttgccaaactcggcttgaatgctgatgcgtccccgccgctcgggagagtcgtcaataatgtcatcgtggattaaagtggccatgtggaggacttcaatcgaggtggccagcttgattaagcggccgcgttgttctggttgcggttggccggtcagggaagcaaagagccagaaaaaggcggggcgcaaaaacttaccgccgttagtggccattctttgcagggcgctttctagttggccatccttagttttgatccgggctgccattaggtcgctaacggctaagagggcccgatttaattcggggttgtgcggaaaatgtgtttgtttcatcattaaatttcctttaaggtttatactgtctattgtaccctaaatagggaattgaataaataagggaaagggtggacttatttaatgtctgtcaaagtatttttagaattggttgaaatcaaggccaagaccgccagtgtcttgcccttcatactcggcctctttttagcggcctatcactaccacaccgtgcaaccaatgctggcgctcctcttttttatcgccatgttcttgtttaacatggcggtcgatatgttggacaactaccacgattacgttcacgccgtcgacaccgaggactatcagcaaaacaccaacatcatcgggcgcgaaaacttatctccgcacttagtgttggcgatgttgatcaccctagtggttatcgccgctttgctgggaatctacctggtgacccaactagggctgaccttgctttggctcggggtgttttgctttgcggtcggctttttgtactcatcgggtccctttccattatcggggctgccggttggtgaattcttctccgggttcacgatgggctttatgatcaccctgatttcggtttttgtgaacaccggagcggactttacctggtcttggactaacctgggggttattttcttagtggcgctgcctgatgaactatggatctccaacctgttgctagcaaataacatttgcgacgaacaagaggataacgataaccaccgccacacgattgtccactttatcggtaagaagtgggcgctgtacgcctttgcggttaaaaacaccattgcctttttagccattattgcggcggcagtgttacgcttaacgccgtggacggtcctgttgacccttttaattatcccgtttgtcgtcaagcaaaccaagcttttatttaacaagcaggtcaaaaaagaaacctttccggcggcgatccggattttactaatcggttcccttgtccaggtcgtgacctttgcggtggggttgatttaacaccaattaacataacattaacgaaaagcgagcgacagggaaattttcccgtcgcccgcttttttgtttattgggcaccgtgcttttcttgttttaagacctgttgtttaacggcgcaatcgtaatcgcaagcggcacacttgcccttcttggcccgcttaaagaccttaacgagttgccaaaaggcgcagccgatgattagcaaaatgatgacggtgttggtaattaaactaagcatgggaaactcctttctaaatgaagaggctgccgaccgtgtaaatcagccaggccaggccgtaagcaatgatcaggctagaaaccaaggaccagattgtccacttggtcgatccggtttcttgcttgatcgtccccaaggtggcaaaacacggggcgtacaagaggataaataccaagagggcgtaagcggcaaccgggttgatgaattggcccagggcgctaatcaagaccgcttggctgctggtgtgaaacatcaccatcatactggaagtgatcgcttctttagctaagaccccggtaaagagggcggcgatcgtttgccactgggtgataccgaccggtgcaaggaagggaaccaacaggtggccaaggctagcggcaaaggagtggctagaattagtgacgaaaccgtgggggccaaaggaggccaatagccaaatgatgaccgtcccggcaaagatgaccgtcccggcttttttcacgaagcccttccccttgtcccaagtcccgtgccaaatgacgtcaaagcgggggaggtggtactgaggtagttcaacgatgaagaccgaggagtcggtgacgccaaagtagagttggtaacccttagcgactaagagggcgacgataatccccaagaagtaaactgataggacaatcagtgcttggtgcttcgggaagaaggcggcgaccaccagtgagtaaactggcaggcgggccgaacaggacatgaatggtgaaattaaggttgtgattaaccgttcctttggttgctcaattgttcgcgccgccatgatcccggtcacgttacacccaaagccaatgatcaagggaataaaggacttcccgtttaatccgataaactgcatgatccggtcagtcaccagggctgcccgggccatgtaacccgaatcttctagcagcgagatgcaggcaaagaggacgaaaatttgggggataaagaccaagatccccccgaccccggcgatcaggccgtccacaatcaaggaccgtaacactggtaaggccccggctgcggtcaggacctggtcagcggtggtcgaaagggggccggagatgaagccgtctagcatgtcagacaggggcgttcccacccagtcaaaggacagtttgaagatcaaaaagaagatcccggcaaaaattggcaaccctaaaacggggttggtcacgatccggtcaatcttagaggtcatttccactttgctggtcgaggcgatgggttggctggccgcccccagcaacttttcgatgaaggcaaagcgggtattgaaaatctggtcttcgaagttttgggcgtcgtagtatttttcctggctacgcagcggggtcaagtccctaaagagggcgaagcgtcggaccgccttgtttttgttgatgtattgaatcgaaagccactgggcgtaatcgtggtccatatcgtaatctttgacgagggcctcggtggcctgacggattgcctgcttaaccatcggcgggtagtcgaggagcagtggtttggcctggcggtgctcctttaagctggccagttcggccttgaggacggcgaccccctcgtgggaacgggcgttggtggtcttcacctcacagcccagccattcttcgaggaccttggggtcatagtacttgccctggcgctttaagtcgtcgatcatgttgaggtttaaaatcaccggcgccccgagttctaagacctcaatggtcaacaaaaggttgcgcttcagttggccggcgttggtgacgtttaagatcaggtcggggtggtcgtttaataggtaagaagtgacgatcgcttcatccttagttaaggggtttaaggagtagacccccggtaagtcgactaaggtcacggcgctgtccttaatttggccaagctttttttcgaccgtgaccccggtccagttcccgacgtaggcgtacttatcggttagggagttaaagatggtcgtttttccggtgttggggttacccaagagtgcaacggtggtcatgactccatccctcccgttagttgacaaaagacccggtaacgtaggccgattcgctggcgatcactttcgatgatgactggcccgtggaatggatagcgttggatcaacgccacgtcctttccttcgtataaaccaaggttgtggagccgctcttgggtggcttcgttgagcagctcaaagtgggtcagagtatatttagccggcatcaaaaacccctccttgcaatattattccaaaaatatataatgaattgcctgatattttcattatattagttagtgatattattatacaagattccagaaacagatatcggggaatttcctagttttattttaccttgtaacgactataatgtaagacaagtgattaataaacgggccccagttggattctttatatagaattggaataataggcctgatttggaggaattgacatggcaacattagaagttaaggacctacacgtttcggtgaccgatgacgagacaaagcaaaccaaggagatcctaaagggagttaacctgtcgatgaagactggcgaaattcacgccatcatggggccgaacgggaccgggaagtcgaccctttcccaaacgatcatgggtcaacccggttacacagtcacggaaggtgaaatcctcttaaacggcgaaaacattctcgagatgccagttgatgaacgggcgcgcaaggggctattcttagccatgcaatacccggctgaaattcaaggggtgaccaacgccgaattcctgcgggcggccatcaacgcccgccgccccgccgacgaccaaatctcggtgatggactttatcaaaaaactggaccacaacctcgccctcttggacatggatgaatccatgaccgaacgttacctcaacgaaggcttctccgggggggaaaagaagcgtaacgaaattttacaattattgatgatcgaaccgtcctttgccatcctcgacgaaatcgactccggtctggatatcgacgccttaaaggtggtctccaagggggtcaactcgatgcgcggtgataactttggttctttgatcatcacccactaccaacggctcttgaactacatcgtgccagacaccgttcacgtcatgatgggcggcaagatcgtcaagaccggtgacgccgaattggctaagaaactggaagcagaagggtacgctggcttgcgtgacgaactgggcctcgacgtcaagctcgttgatgacaaccactaaggaggacgacgatgacattagatgttcaaacgatcgccgaccaaatagaggaagtttcccaccaacacggggagccctacaccttattggatcggcgcctggaagctttgcaactgatggccgaccaaaagatgccaacgattccgcgttaccactttgaggattggccactgttaagcgaccaaccactggcctttgaggattccgacccgcacctggccgaggggttgcttgactccgacccggatgtgatccggattgtccaagtcggtcaaactaccaccgaggttcagctgccggaagaactgcgccaacaaggggttatcttaaccgatattttctcggcggcccggattcatccccgcttgattgaacgcttctttatgaaccgggtggttaagccgggggaaaataagatgaccgccgcacacttagcctttttaaacgccggggtcttcttatacgttcccaagggggtcgaaattgacaccccgatcgaagccgagatcattcaagacgccaccaaggaccaaccgttaaactcccacctcttgattgtcgccgaggcccagtccaagatccacttcctccagcacttacaaacggtcggggaacggtcggtgccggctaacatgatggtcgaaatcgtcgctcaagaggggagcaacgtcgccttctcctcgctggatgaattggggcctaacacccacgtttacttcaagcggcgggccaacattggccgcgatgctcacgttgaatgggcggttggcttaatgaacgacggcaacaccctgggggacatggactccgaattgattggccaggggggctatgccgacgctaaggcgatcgccgtgaccaccggcagccagttgatggccgtcaacaaccgggttactaaccgcggcaagaagacgaccgggttgattaaccagcgcggggtcctacttgaaaagtccgagttgatctttaacgggattggtcaaatcgttcacggggcgcacggggccaaggccgaccagcaaaaccgggtcctgatgatgtccggggatgcccatggcgacgccaacccgattcttttgattgacgaaaacgatgtggtcgccggtcacgccgcttcggtcggaccagtcgatccggaacaaatgtattacctaatgagccgcgggattgaccgggcgaccgccgagcggatggtcatccggggcttcctgggctccgtgttaaccgtcattccggccaaaaacgttcgcgataagctggtagcggtactagaaaggaagcttgcagatggacaaaagtattagtgaccttcgcgctgactttccgattttggaccagcgggttaacgatgagcctctggtgtacctcgataacgccgctacggcccagcgccccaccccggttcttaagcaggtactcgacttttaccaaaccgataacgccaacgtgcaccgcggggtccacaccctagcggaacgggcaaccgccgattacgaagcggcccgcgatagggtgcagaagttcattcacgcaaagaagcgagaagaagtgatctttaccaaggggtgcaccgattccttaaacctggtcgccgccacttacggcgagcaaaacatccaggccggcgatgaaattgtcatctcaattatggaacaccactccaatttgattccgtggcaacagctagcgcttaaaaagggcgccacccttaagtacatcggtttaacgaaggagggtgaattggatctggcagatgcggcggctaagattaccgaccgtaccaagatcgtcgccgttactcacgcttccaacgtgatgggaacggtgacgcccttaaaacaattggccaagttggcccaccaacacggggcgattatcgtcggcgacggggcccaagcggttccccacatgaaggttgacgtaaccgaattggacgtggacttttacgctttttccggccataagatgatgtcgcccaccggaatcggggtcttgtatggcaaacaagccctgttggaggccatacccccttatcagtacggcggcgaaatgattggcacggtaaccgaacaggcaagtacctgggcggccctgccgtacaagtttgaggccgggacccaaaacatcgccggggccgttggcttaggggcggcgatcgattacttgacggcgattggaatggaccaggttgaagcccacgaacgggtgctggtgcaaacggtcttgcctcaattactcgcaattgaggggctaacggtttacggaccgaccgacccggctaagcacaccggggtgatctcctttaacctcggccacctgcacccccacgacctggcgacggcgctagacatggaaggggtcgccgtgcgggcgggtcaccactgcgcacaaccattgatgaattaccttggtctggaggccagcgcccgggccagcttttacctgtataacaccgcggctgacgctgagaagttggtgtcagcactaaaggaagcaaaggagttcttcagaattgggactatctaagttaaataatttataccgggaggttatcttagaccacgctgatcacccccacaacaagggagccttaaaggacgccactaacgccattaccttaaataacccgacttgtggtgacgaaatcgacttgcaagtcaaggtaggttcagatggcttaattgacgaaattggctataccggtcacggctgcacgatttcacaggcatcggcgtcgatgatgactgaagccgtcaaggggaagcgcccagacgaggctctggcaatggctaagatcttttcggacatggcgatcggtaaggaccatgacctagcggacctacaagcgttaggggacgcccaggtgctaaccagcatcatggaattccccgcccgcatcaagtgtgccaccctagcttggtgggccttacagcgggcactgttaaaggacactgatgaggaggatattgatgaccaaggctagcgaaatcctgcatgacgaccaggaatacgaatatggtttccacgacgacatccacccggtcttctcaacgggccgggggttaaccgaggaggtcgtgcgcgccatttccaaggaaaaaaatgaacccgagtggatgctcgattaccggcttaaggcgtacgaaatttacaaagcgatgccgatgcccaagtttggcccggatctatcagaactagatcttgaccacatgctctactaccaaaagatgaccgacaagaagttccgcgactgggaagaggttccggacgacttaaagaagacctttgaccggctaggggtaccagaggctgaacgtaagtacctcgccggctcatcggcccagtacgaatccgaagtggtttaccacaacatgcgcgaggaattcgaaaagctcggcattatctttaccgacaccgataccgccctacgcgagtacccggacctgtttaaagagtggtttggcaagttggttcaaccagatgacaataagtttgccgcccttaatgccgccgtttggtcggggggctcctttatttacgtgcccaagggcgttcaaactaaaacgccgattcagtcttacttccggttaaactccgagaataccggccagttcgagcggaccttgatcatcgtcgacgaaggggcctcagtcgattacgtggaagggtgtaccgccccgaactactcatcggactccctgcacgccgccgtggtggaagtgaacgtcttaaaggacgcctattgccgctacacgacgatccagaactggtcggataacgtctactcgctggaaaccaagcgggcggcggcgatggaccacgcgaccatggaatgggtcgacgggaacctaggctccaaggtaacgatgaagtacccgtccgtttacttagatggtgagggggccaaggggacgatgttgtcgatcgccgtggcttctaacgggatccaccaagattcgggggcccggatgatccacaacgccaagaacacctccagttcgatcgtttctaagtcgatcgcccggaccgggggctcgactgactaccgggggaccgttcgcttcaccaagaacgctgaaggctccaaggcccacgtcgaatgcgatacgatcattatggacgaccaatccaagtccgatacgattccttacaacgaaatcaactgctcgaacgtggcgatggagcatgaagccaaggtttccaagatttcagaagagcagctctactacctaatgagccgcggaatttccgaagaaaaggccactgaaatgatcatcatgggctttgtggaaccattcaccaagcagttgccgatggagtacgccgttgagttaaaccgcctaatttcctttgaaatggaaggctcaatcggttaataatttttaaagttagggaaaaccctaattttgcctgaaatcgcaaccaagacccccacaaaaccttttgtgggggtcataattttttatgaacaatgtttgaatatggctatttaataaaagaataatttattggaatagccattgaggaggaaaaatcaatgaagttcaagtggaagcgttttgcgggcctggtactggccggaaccttactgaccggggtcgttgcaccggttaccgggattaccgctccaactaccgttagtgccgcagctaagaccaagacggttaccgatatgaccgggaccaaggtgaaggttccaaccaaggtaacacgggtggctgacctctggcacgccagcaaccaagtggtcttgttgcttggcggccaaaagaagttggttgccaccacgccaataatcaagcaagagggctggtttaaaaccgttgacccaggaatctctaaggtaacggcgccgttctccggtcaagacattcaaatcgaatccctggttaagacgaagccggccgttgtgatttcatccaacccggaacaagttaagcaggctaagcaagctaacttaaccgccgtgaacgccatgttccaagacttcgccgggatgaagaagtcgatcactttgacggccgacatcctaggtggggacgccccgaagatcgctaagaagtacatcaagtacctcgacggcaacatctcctacgttaaaaagcaacttaagggtgttaagactactccttccgttttgcacatcacgagcccagctgacctgactaaggttgatgggaccaagacgatcgttgacgaatggattaagatggccggaggtaagaacgccatcactactgccggtaacatgatcaccgttaatgccgaagacatcgtgaaggctaacccaaacgtgatcatcgttggtcaaaccacgaccgccaacgctcgtaagctcttgaaggctgattccaccctttcccaattgaaggctgtcaaggataacaaggtttacggtaacccacaagggacctttccgtgggaccgttacagtgctgaagaagcgctgcaaatcctctgggccgcccaaaagcttcacccagaccaattcaagaacctggacatggttaagaagaccaagtccttctacaagacttactacaactacgacttaaccacgaagcaagctaagcaaatcctcgccggggaaatgccgaagtaagcttaaattaccacatcaaacatttggctcccttcccgggggccttttttgtatatcctgtcaacgaatcaccactatggtaatccatcaacaagatttagtgtagagccacaaaaaacgggcggcgacataagtcaccacccgctttttaaaaatgattacgccttagaaacgttggctgcttggagcccacggtcgccggtttcaacgtcgaacgttaccgattgaccttcttctaaagtcttgaagccgtcgccttggatggcggagaagtgaacgaacacgtcgtcaccagcttcgcgggaaataaacccgtaacccttttcgtcattaaaccacttaatagttcctttttccatggatgaatcctcctgttaaaacaaatgtatcaaacttggtaattctacctgagcaaactgggagattccttcaatgaaacaatttaccacttcgtacccgagtcaaactacttttataagtatagcatgcgccccactataaagctacttatttatctttcggcgtaataaaaacgttgtgcgccgccttgtaagagatgttgagcgtttgaccatccgttagtcgctcaaccacgaccggcccctcaaagggttcgtgcttaacaatcttaatgtgatcgcgcaaccgtaagccaatctcactaaggtaggtcaaaaggtcgtgattatccaagaagcgctcaatgattacctcttcgccatcttccccctccgccagtaagcggtggctaatattggtgaagcggccgttggcactagggatcacgcccccatgcgggcagtaggccgggtgccccaagaaatcatccaaggcggttgccaagtggtcgctggtcttgtgctccaagatctcggcctcggggtggacgtcagtcatgttatagtgaagcttatcaactaagaaggtttcccacaggcggtgcttacgaaccaattccgctgcgtagcgtccccctttttcggttagagcgatgccagcgtaaggttcatgctctacgagtccttcatcggccaacttggtgatcatttcggtcacggacccggcggcgattcctagccccagggaaatttccttattggaaacctttttgcggccccctcctagctcaaagataattttcaaataatcttctttcattggcgtcattgtatcgcctcaaaccttctttctttttgttcggatcactttgtcccggttgaatccagaatgattatagcatatcattaatttaacgatttggataacctaaacttttgtttttaaagaattaattttttcctgtaccaaggggggagaccaatgcataacaaccgggtgagtggcggccgttttctagccgtcaccatcttaaacgtcgccattaccattgttgaaatcatcggggggctcttatccgggagcctcgccctactttccgacgcctttcataaccttggtgactcactttcaattgtgctgggctactttgcccaatcaattgccggacgaccggaaaaccaccggcgcacctatggttaccggcgggcggaaattctagccgccatgctaaacgccctatttttaatcgtggtgtccgtctttttaatcattgaggccattaaacacctccaccatcccgaacacgttaacggaccaatcatgctcaccgttgccattgtcggtttactggccaacctgatctcggccggcctcttacaaggagggagtcaccacagcctaaacgtcagagctacctacttacacgtcttatctgatgccctatcttcggtcgccgtgatcctcggcgggctagttctaaccttcgtcaacctcccctggttggacccggttttaacgatcgccgttgccctttacattggctatgaagccatccccatcattcaccagactttgagcattctaatgcaatcggccccccgcctcgactacgaccaaatcaaacaggacctgctcggaattgacggggtcgtcaacgtccaccacgtccacgcctggtcgatcgatgaacaccggatcatcttttctgcccacttgaattgccaagacatgctcttgagccaggttgaagaagtctaccaccaggccgaacaaatcctcgaaaccaagtacggcatttgccacgtcaccattcaagccgagtgcttacggggtcaagacgaggagctcttcgacaccccaccggaccgtcaaagcatttgcaaataatatgcgcttcgtataacgtttaaaattataaaagtgaggcagggagaaaaacggatttctccctgcctcttactgtatatcagaatgttagagagaaagcgtggccaacaactatgggcctagtcatccgacctgcagctaattgccactctctttaaaataaccgtccaacgccgtagtgaatggtgatcgtgattaaaccaatcacgatgtttctaattacggcgaccttaaccaacccatcccccaacttcgagaaaatgtaaccggtcaaagcagacgataagatcactgctaagattgtcgcgtaccacttcaagcccgccggggccaaaatcatcgccattagaggtaagatcccccctagagcagccgcaaatagcgaggcaaaggcggcggcccacgggttgaggtagtggccaagttcaatatcatatttaactcgcacaattgttttcaagggcgccttggccatcaaatcctcagcgattgactgggccgttttttcactgagccccttttcttggtagtaggcccgcacggcgctcacttccccgtcccagtccgttttcaacaggccttcttctttggcaacggcggcccgttcggtatccttttgggtggagacggaggcgtactcaccggaggccattgaaaaggcacaggccaaaaggtccgataatcccgcaattaagatcgtgaattgatcggtggtggccgcagccacggataccaagaccccgactacggtcaaaattccgtcgttagagcctaagacaccggcccgcaaggtattcaggtgctcttccatcgtttgcttatggaggtttttaaccttaactttttgcattttaatccccctttagcttaacgggcaaagagctgcccaatgacgaaggttaccgccatcgttaacaggccggccactacgttacgaaccaccgactttccgcgttcagcgtcccccaacaccgctgccgcgtacccggtgatacatagggcgatcaaaacggcgaccacggtggcccaaatccgggtggccgccggagtaatcatcaccgccaccattggcaggatcgaaccaagcggaaacgagatcatagaagcgatcgccgccgcataagggctggtgaattcatgggggttaaagccatggcgttccaggacaaccgtccctaacgcatctttagccatcaactcgttggtcgcctgggtggctagcgcggggtcaatcccctgatccaggtacttttgcttcacgaagtcatactcgctttggtagtcttcgtctaggcgttccttttcttcaatcagggccattcgttgcgagtccttttgggtagaaaccgaaacgtattcccccattgccattgagatcgtcccggccagggcccccgataaaccggcaattaaaattgcataactattgctagtggccgctgccaccccaatgacgatccccgccaccgaaataatgccatcgttggcgcccatcacgctagcccgcaaaatgttaatccgccgcgctaacgatgtttttttcttcgccattacgccaccccttcttcttttattttagaaccattataatataactgaatataaaagcaagtggtttatcaaatttatagcttaaaatttagaagagttctaaaaaacggacacaccttaattggcgttgtccgtctcgggcgggatgctattgataatcccggatctcttccgtgcgaatcacaaagactgaggttccggcgtgcttagtcatgtaagaggcttgggagcccaccaccttgcgatttcccggcttactaatcgagcctacaatcagcaagtccggttggaactctggaatgacgtggttacaaatccgttcagcgggacggtccccctcgtctacgatcgccgtgatctttttggggtcaatcccgtaatcaatggcggcctgaacgtattcatcgatccgtttttcgaggtcctggcggctagtgtgaacgtaatccttgtcgagggcttggaagacgttaaccgtgttggtttcgtgaatggatacaatccctaattcactaccgtcacgcttggccttccccacggcgtaggcaaaagctgcccgggcatcgggtgcgtcatcgaccccgacgagaatcttatggaacgtttttggcttaatttcaaacatgaaatttctcctctctttcgggggccggcaacccggattgtccccctaattgtgttcataaattagtattgcactattagcaccgattgtaaatcagattttttagcctttcctaattttattttataaccctagaaattcatcccgttgtcgcagccctgatccgtgctatacttagtcaatcatctttttagggggaccttcgatgctgtttgataagacattttcgcaattaaccaccactgaactctttcaaatttaccggctccgggcggccgtcttcatcgtggcccagtcccgggtcgtccaagaccccgacgacgtcgacctcatcgctcgccatattttcatcaaggacggagacgcaatcgtcgcatacgcccgggtgtaccctgcggacggcggcgtttcctttgggcgggtcgtcaccgcggccagccatcgcggccaaggactgggccgggaattaatggatggcgtaatggactgcatccggaaatatttcccgggaaatcccatccatatccacacccaagaacaggtagaacgtttctaccaccagtggggcttccaaagcgaaggggcgccgtttattctcgcccaaaccccacacgttaaaatgacccaccccgccatataaacaaacctccaccccgaccatcaacttagtcagggtggaggtttttaattagaagcgaaaatcaaggcggtagccaaagctttggtcactccccatcaagcgttgggcgtgccgttctagcaccgtccgccgcttaccgtgcatcatccacaccgttagaaggatgaagaagaccagttccactaacgtcaacacccagctagaggtggttggcgttccagttaagggggtaccccccccagttccatcagccgcaaaggctagccaatcaaataaaaagtgcatcaaaatcgtcaaccaaagctgtccggtgtacaaaaagaccaccaggtaaaaaaggccaaatcccacggtccccgtgatctgcaggacggtatctgctaagggttgaccagccgcgttcaagaggtgggcgaacccaaacagtagcgccgaaacggccaaggggccaccaaggggccagcgggtgttttttaaggccaccaaaagaaccgccaagataacaaagcggcaaagggtttcttccccaattccggcacacagggccaccaaaaagttactgctactagttaggccctggcgcagggtcgttaggctaaccccacctatgttaactccggtcacgaccaggtccacggccaccaggaaggcgaaggtcagccagctccagccccaaccaaatttaggtaggaggccaggccaagccagctcccaggcccgcatgagggtagtagcggtgattaaaaaggccaacgcccccaccacgtgagagctaacgatggtttgcatgatcggcggcccagcgaacttcaccggtagggaaattgtcattcctaaaataatcaacaagaaccagtaaaagctgtagcaaagccgggaaagcccccacttaaaggcacccccaatttcgctagcaaggggggcgaacatgatcagatagtagattagggccaaaacgacgacgccccgggccggaagctggagccgaacgataatttggcgggtcaccgttccccagaccatgagcaaggccagaggctgaaagatggcttgtagccaacggttggtggccgctagccatgtagggaccgccggcagggaggcaacgattagcccaattgccgtaattacgcctaaaaaaatcatcaggtagccctgatggatgccaacgtacatttcccacccactaataacgagcaggaaaaagagtgcggcgaccaattgggtctcataccagatgtgcaggtaatctcttcctgacatcttattacctccaatcaaactttcatttcctataactatgatggtaacaaagtcccgggtcaagcaaaagggaaaagcaaaattttaatgttcgcacaatcaaaaagggccctgccaagttcgttaaccgaacctaccggaaccctaattgcttacgaaacctgatttaactattcggtgaccgtagccgtttccttcgcagccgttttcttggcgttcggacgacacttacggttgttacgccgggttgccccggatccttccttaccatcttcggcttggtttttctttggtgcccgttcctgagcatcggcgtttaggatcgtcaccatcggaataatgactgggcgccggccggtccggtcgtacaagagccgttgcaaacgtaagacgatcatccggttaatggcccggcgatcaacccgcttgtggttcttgaaggtgtttaggatcgcccagaagacttcgtgattggccgccttgatcagttcttgggattcgtgcatgtaaacaaagccccgggaaacaatatctggccccgccacgatctggtagtcctttaagtcgaccacggccaccgccgttacaaccccttcttcggagagcatccgccgttcgcgaatttccggatcaccaactgaatcgctgacgtcgcgtccgtcaatgtaaacgtcccccatcgattcgatgtggtcggctaagcgacaggtgtccttggtcaaggccagaacgtccccgttttccaggatgaaggtgttttcctttggcaccccggtcaattgggccagcttagtgtggatcttttgcatccggtattcaccgtggaccggggcgaagaacttcggcttcatcaagcgcaacattagttcttcgtcaatttggcccccgtgcccggacgtgtggatgttgttaacgtaaccatggataacggtagcgccgctttcttccaacttgttaatcagggcgttgaccgaagtcgtgttccccggaattgggttggaggagaagaccaccgtatcttcaggttggatcgtgatctgacggtgggtcccgttagcgatccgtgacagggcggccatcggttccccctgcgaaccagtacacatgatcatgaccttttccggtgggtaggagtttaactcgttggggtcgatcaaggagtcttccgggatctttaggtaacccagtgcctgacccgccgcaatggcgttttccattgaccgaccaaaaatggcgatcttgcggccctggcgcatggcggcgtcagaggcttcccgcaaccggtaaacgttggaggcaaaggaggcaaagatgatccgccccttaattcgttcgaagacccgccgaatatggatgtcaacccagcgttcggacttagtgaactccggccgttcggcgttggtggagtccgaggtcaacaagagcaccccttcttcacccagcttggccatttgttggaagttgggcgccggcaagttgccaaccggggttaaatcaaacttgaagtccccggtttgaatgatcgtcccttgcggggtgtgaaccgctacccccaccgtatccggaatcgagtgggtagtccggaagaaggaaacccacagcttcttaaagtgaacctcggagaattcatcaatctcgtgcagttccgtgctccgcaagaggtgcttttcgtctaacttccccttaatcaacgaggtggcaaacggaccggcatagatcggcacgttaaccttttgcaagaagaagggcaagcctccaatgtggtcttcgtgaccgtgggtaatgaaaatccctttaatcttttccttattttcaactaggtaatcgtaattttgaatgacgtaattgaccccgagtagttcgtcttccgggaagagtaccccacagtcaatgatcacaatttcatcttggaactgaacacagtacatgttcttcccaatttcccctaggcccccgacagcaaagaaggccacttcattattcttaatttgtaacttacgcataagtacctttcctttatctttagttgcgataacgatcggaacttctggatacaccaaaaggagggcttctccagttgttgccgccctgacgtttaattcagtttttcgttattttttcgtccgtaataaactatgaatagtttaccacatgcggggggtgaatcatagttggatcacctgagtaactaaaacggggccaagagaaagcgaatttccctcaaccccgtttaaatctttaaagatagttcggttttagtcccctaagcacaaattagttttctttaattaggccggcgtgcttatcggcgtaccactgttgccaagtagtagtggtatgcccccgttgatcataggtcatgtcgagggccgctaagaccccccggtaagccgctaccgtcatccggaggctaacggcggtgtcgtgttcaatcgtcccctgccggttctcacctaaaacgtgattaatttcagccaccaagcggtcatcggccagggccgcaatgatctccaaatcatcgtgcttgaagtgtgctacgtaaaaaggagcaaattccattaccgccacggtctgtgcttcgtcatttaactgattaaattggtattgttctggcattttttgccttcctttcacaaccaagacaacctgtttctactatataaatatagcctagcactttttagcgggttcggcatagaagagtcaccaattatttagtatcaaacaggcgtaactccacgtggtcatcttctttgacgatcgcctccaccgacttcttggggtcgtctgctaagggccctaaatcaatgcgggttccctccttggtcgcctctatttcaaagacccggtcaataataaagcgctgaaagtccttcatttgactgcgccgttcgtcttcttttgcaaccgccactggtagggtgtaaccctcatctaagtagtacttaatccccattacctgaaagagggttgctaactggtatttatggctggaattttcttgggtttgctccgagtggatgtagcccttgcgctcccaatagcggagctgactgggtgagacttccgcggcttcggctagttctcgcatacttagccgcaggttcgccttgataaatcgtttccggtagatcgatgctagcgacacgcctatccctcctcttaatttacgaaataaaacagggttattatctaattttgcgtaatctttgtcaaataatttgacaaagatctccaagagtaatatattaattcctgtttaaattttacaaacagtaagaaagaaggctttatcttgcagtccaatcaacgaccaatggacatcaacggcaagccatacaaccgggcgattctggttgccgtgctgaccgttggttccttctttacgatgttgaccgggaccttcttggcgaccgcttaccccgccatcatgcgttcctttgacatttccacttcgaccgttcagtggttgacgactagtttcatgctggtgaccgggatcatgatcccgatctcggcttggttaatcaacaagctgaactcccgggtgatgtacatttcggcgatggcgacgttcttaatcggaacgatcatcgcctttaccgccccgaacttcggcctcctcttaactggccgggtgatccaatcaatcggggtaggggtttcgatgccgctaaaccagaccgtcatgttatcgatcttcccgccggaaaagcggggcgccgccatgggggtggtgggggtcgccatggggttagcccctgccgttggtccaaccatgtccggtttgatcgtcgacaattggtcctggcgggacctcttcgggatcatgattccagccatcgtgatcgtgattgccctagccctggtttacatgaagccagtgctaaaggtgcaccaacaaccaatggatctttggtcaatcatcacttctacggttgggttcgggggcctcttgtacggggtttcagaagcatccaaccgcggctggggtgacgccttagtcctgtcttgcatcgtgatcgggatcatctttatcgtcctttttgcccaccggcaactccacttggacgaccccttcttggacctaaccgtcttcaagtacggtgaatttaccctggcggccgttttatccagtgccgttaacttggccatggtcggggtggaaatgctgttgccgttatacatccaaaatatccgtggtgaatcggccttccactccgggttaatgctgttgccgggggctttgatgctggggttaatgtctccagtaactgggcgcttattcgaccgttacggggcccggttcctttcgatcaccgggttgaccctcttgatcatcggaacggtgccgtttttaaccctgactaaaaacacccccgttatttcaatcgtggtcttctacgccattcggttatttggggtctcaatggtcttcatgccggtaacgacctcggggatgaacgtcttgccaatcacggaaatggcgcacgggacggctgttaacaacaccttccgccagacgatgagttccattggtaccgccattatgacaaccgtcttgactaacgtcaccaacatgcaaaaaccaacccacgccctactagaaaaggcgcccctttcctacaaggaccactacatcaacgctactctggccggtttccacgccgccttcttggtggccgccctctttgccgtgatctccttgatcctcgccttcttcctgaagaacggtaaccgggcccgcgaaatcgccttgcaacaatagaagggggaataagcaatgatcatcgtcttagtattactatcaacaattgccttttacctcttcaccgccgtttggcaaaaaatgcccggccgaacgctctggtcgttagtaagtctagtcgtcttggtgctttcgatcgtgtcctttgttttacacgataaccgccacatgggaatgaaactagaaacgaccaacaccacttctagcttggtgtctcccaacaagaacctcaacgtcttagtgtacaagcagctaggatctgggagtgaaaaggtctacgtctacaagaccgaccccaacgccaagaaaaccactacgacgcgcctagccgccaacactaagtcaacggtgaagaccaccacgtcaaccaacgccacggtggttaagcacaccaagcgttgggtttacaagaatggtttttccaagctgatgtttggcatcttaggcgacgataacgaagtcgaccaagtaacctacaccttcaacatcaacgaccagtggctggttctttctagcacccaagccgctaagttacaagccctgatgaaggacgtcaccgctcaagcagcgatgaagtccaaggtcgctgccctagtccaggaggaagtggccgccaaactcaaggctaacccaacgatgagcgccactgaccaagccgcgctccaggctgccgctttaaagagcgctgaggcaaccgttatcggccaaatgttaaagtaattaatgccacactaaaagggactctccgaattggggagccccttttttgtggttagaggaattgttagctaaagagtgtggggtaaataactacttgatgttgataaagtcgaccttgaacaaacgtgccaattgttctaattgttcttcgcttagggctagggtcaagacggtgtggtgaccaccaccgtacttcatccattgcttagcaccctcagccaacccaatttctggcgtccacatttgcttagcgaccggcaacttcggcatttcggcttctggcgtcttgcagtcaaccgggtagccaatgaacttgtagccatcatcgaagtaagacagggtaatgtcgtaacccttcccttcggccccagtgaagaccaggcgcgccgggtcgtccttgccaccaatccccagtgggtgaacttccacgcgcggcttgtcggaggccagggttgggtcaacttctagcatgtgcgaacccatgatggcttcgtgaccgtgacgaaggtccagcgtgtagtcttccatcagggcggtttgcttgttgtcggcggcaatcttaagcaatcggattaagccggccatcttgaagtccccttcaggaccaaagccgtaaccatcaatcatcaacagttgaacggccagccctggcagttgttctaagccttccaggtcttggaagttgtcggtgaaggcatcgtagccattgtcatccaagaacttcttgatccccaggtattcacggagttggtagcgaacgttgtgaacgtacttttcgtggtcgttgtcaccttcaaccaagtcatagttagcttccaagtccttgtaagcggcgtcgatttcgtcttcggcgattccgtttaccaccgctaccaattcgttggttgggtagtaatcaactgtccaaccaaacttgtgggttcacttcaagctagttttctctcaacctcttactgtcttttcaaaccttggataacaaacacgggaaccaaccgtccaccggaagttatctcccactccccactaatttaacccatcccacagggtcttgaaggcaaccggcatttcaacttcaaaggccaggttcgtttgggtaaacggatcggtgaaggccaagtggctagcgtagagggcttggtggtcggtcatgcttaggtcaccgccgtacaagtggtcgcctaaaagtgggtgacccacgctagccatgtgcacccgaatctggtgggtccgcccggagtgtaagcgcaagcgcaccaaggtccagtcgccccgactttcttcggcccagtactcggtcttcgccggttggccagccgggttaacctcacgttcgatttgccccttgatgcgggcgattggagcgtcaatgataccatgctccttagcaaaggttccggccacaatcgcccggtactctttttgcatcgtgtgcccctcaacttgggggctgatcatgctggaggcgacgttgtgcttagccaccaatagtagtccggccgtatcgcggtccaagcgggtaattaagtgggggcgcagatccggcgcgtccttggccactaggtagcccttcacccggtttaggatcgtcccgttgaccacgtgggggccgggaaccgaggctacccccactggtttgttcacgaccaaccagttgtcatcctcgtagacaatcgtcagtggctcttcggaagtcgctacggtggcgtcacccggttcaggttggacggtcagggtcagcggttggttcggcaaaattttggtggttggccgtacccgccggtggtcgacttggaactcgccagccccgtttttgatgtcgttgaaaagacggtgccccatccctagcgaatgaagaaaggttttaatcttaattggttcttggccccggtagacccacgtgttttccatctcggcttggctccttttttctgttgaatgtaaaaaaaccggatccgaagacccagtttttgaaaaattatacggtccgtacgagactcgaactcgtgatctcatccgtgacagggatgcgtcctaaccagctagaccaacggaccatttaacaacaaataatagtatacgggagagtgaattcaccgtcaaccattttttgcttttttgttcaaaacaggagcgccctttcccattccccggtataatgaatggcgaataggaggagaaaaaatgagtcacctgattagtcaactcaagaccctttggggacattattcacgctacttaaaggttatctttatcatttcggtaatcctgtttgtgattacttctttgaccgggttcctgcgcggcgttaactgggaccgggtcggcgacgggctgagctcgctttcgcccttaacgatcgccctgctcaccatcgccgggattgtctctgtcatcccgatgctgggttatgacgtcgccatcacccacctcttgcctggcaagtttaccgtcggccacatcatcaggagcggctgggtcaccaacaccctgaccaacgtcgccggcttcggtggcctgctcggggcgtctctgcgggcgactttttacggccagcaggccagcaaaaaggaaatcctaaacgcaattgccaaaattgctatcttcttggtggccggtctatcggtgatgtgttgggtcgccttggtcctcatgtttggttttcaccaggggggccactttaaccgttacgccatctggctggtcggcggtggactatacttcccggccgtctttttcttcacccgctggaagtccaagagcctctttgccgacctgtcgtggcgcctggaattattgatcatcatttcctcgacgctcgaatggctaggggtcgccctcttcttcgtcttcgttggggcaatgatgggcgtccacgttaatctggtcgccgttttcccgctttacgtggtcgcccaactgctcggggtcgtttccatgctaccgggggcgctgggttcctttgacctaatgatgatggtcgagttggtcatgctgggggttccccacgccaccactgtcgtctggttggtcttgttccgggtcttttactacttgattccactggccctggccgggatcttctttgttcactacctctggctccagctcgataacttcttggaccacctcccgcaagcggccggtcaccaagtcgcccactgggtggtgacgaccttcatgtacggctcggggatcttgatgcttttagccgcttcggttcccgacctggccgataacaacaagctcttgcaacaggtctaccccttcacctttttcttcttgcatcagctaacgacggtggcctttgcaatcgccctgctggcttgtgcccgcgggatccaggccaaggttgctaaagcctactggccctcgctagccctgctcgtaatcggaattgccaacaccctgtggtacctaggcacccttagcttagcgatcttcttagcggtcctatttttcttgaccctggcgatgcgccacgtcttataccgtaaaaaactccagtactcgctaggtaagttcaccctcgacgccgttatctacgccggggcggtgatcttatacgtcatcgttggcctcgttaacaaccccacctacatggccaagcactcgatcccgagtttcctactcttccccggcgaaaaggtgtggctgtcgggctttattggcatcctgatcggtctgtcgatcatgcttttgatcatccactacttcacctcggggcccgaccccttcgctggcgaacaaaagctaccggttgaccgggtcaacgccctgattgaagaatttgggggcaacgaaacctcccacctggcctttttaaatgacaagaacctctacttctaccaggttgacggccacgaccgcctctttttcatgtaccggcgcaagtacgacaagttgatcgtgatggggaatccggtcggagaccaaaccgtcgtccgcgaggcgagcctagaatttctacgcgaagccgacttatacggttaccaactggtcttttacgaggtcaatagccaactaactatgctcctgcacgaatttgggtttgacttcctaaagaccggtgaagacggattggtcaaacttgccgactttaccttggccggtaagaaacaacgctcccaacgggccttaatgcacaagtttgagcgggaaggttaccaattcaccatcgttgaaccacccttttccgatgagctgatgcaagaaatgcgggccgtttccgacgactggttgggtgaccaagttgaaaagggcttttccttaggcttctttgatcccgactacatcaacaccgccccggtggccctggtcgatgacaaggacggcaagttggtggcctttgccactctgatgccgaccgggggtaaggagatcctgacgatcgacttgatgcgtcactcccacgccgccccgtccggaatcatggatatgatctttgtttcaatgttcttgtatggtcaggaaaagggctacacctacttcgaccttgggatggccccactagccaacgttggtgaatcgcggtactcctttaccgaagagcgggctgcccacttcatctacgaatacgggacccatctctacggcttccaaggcctgcgccgctacaaggataagtacgctagcgagtggcactcccgctacaccgtctaccgcaagaaaaactccctgttggccaccatgatcgccctagtatcggtcgttaaccaacgtgccgatcaaaaggttgaccgccacccactaatgatgtggtggaagaaataggagtgtgacccaaccttctatataccatcaaataaaaaccgatcaattcgcaattatttgcgagttgaccggttttttacttggaaagaagtttgacaatctctatttcattttcactattacacagataacgtggtcaccaaccgcaggcctagtatctaagtacggccgaagaacgctgcttaacacagcaaccttctgcctagcttagctatacaccctgccatacaggttggttcccacttcgaaacccaggtgcgagggcgttttattgtctagtggttgttctctaataggtaagggtagagcatttgacgacgaacctcggcagcatccacccctaaggcgtccgcaatgcaataggcaaaggccaaggccgttgccggtccccggctggtgatcaactttcccttttcatcgaccacggtaatgtcttcgtggaaacgaccgctgggagcgacctgcgtggtcgtttgctcaatccccggaaaacaagtgtagtcgtgaccatccaagagtccgtagcgggcaaaggcaattggggcggcgcacatggcggcgttccactcccccgcttgttggcgccgctgcaccaattgcatcaagcgatcatcatcgcgcaatgcctttgcgccacccgagccgccggggaagaccacgcaatcgaaccccaagagcccctcgcctacttcggctaggctagtatcgcaagttaaggcaatctggtgggcccccatcacttggcgatcatctaggcccaccatcgtcgtttcaatccccaaccggcgaaaaacatctaccggcgtcagggcctcgatttcttcacaacctggggcaatcattaccgctacttttgtcattttgaatccctctttctagctgttcacaacccgtttgatctcttcaaccgcctgctcactctccgggctttggtaaaccgggtaaatgtgatacaggttccgcccgatgtgggtggttaccgggacgtgttgctgacggagccgctccgcaaagtccatggcgtccgggtacatcaactcttcggtccccacaaaaatcgtcacgtcgcgtaagggcgacagggttccgtacagcgggctcacctgccagttacggtggtccaacttagcagcccatatcgcccctaactgccgaagaccggcggcgtttaaggtaacgtctttttcctcgtagtcagcgacctggggattagttaaatcgatgtctaaccacggtgaaatcatgattaggtgaccgggttgcggaagcccccgttcacccaggtactcgcaaaaactagccgccaacccggcgccagccgagtcccccattacggtcacctggctgaccggcacctgggtgtagacctcgttatagatctgtttaagcacggcaaaggcgtcctcaaccgtgtgggctggcaaggtcgggtaaatgggcaccaccacttttgaagcggtcctgtccgccaaccggttcaaaaactgccagtgctcctttagcggccgctcaaaaaaggcgcccccggttaggtaaataatgaccgggtgttcctgcaagtccgcgttgagcgtaaagcactggctaccggccacttcgctctccttaaccgggacggtgaacttaacgtcactgggtaattgaagggggcgttcactttccaccgccgccctttgcaatgcatcagccagtttagtcggggtggagagtgtctttttaaaaccagacacccggatcgccatttcagttagggtggcccgctgggaacggtggtggccacacttggtgacctcctttagactgctcttaatgcttgtcacaattccgcgggctatttggcggtcaaagtgacgccgctttacgttcctcatcatctgcgttccccttatcaaaattttgtgtgcattcctcgtttctctctagttaaaatcctaacacggtccacgccccggtcgttagcgatttcccgttaagttttggtaaaagaagggaagtgggaaatgaccttctcgacagaccgtatgactaagctagggggaaggttggtgccttggcaccgttcttcgtccgtacttaggcactaggtctgtggtcattttccaccaccccttattgcggcatcaaatgctgttcttttagccacttcccgaaggcctgccagtcggcacgcacggtcggttctaggcgccgagcgtacaaaaaggcggccgggtgatacattggcacaatgtagtaaggggtcgtccccatttgataaccctggtgatccggccgggtttctaagaccgactggtgcaagacctgaccgtgcaagtcaccaatcttggcctctggtcccagcaagcgttggaggctggtgttgcctaggggcacaaccacctgaggagcgactgtctttaattcccagtcaaagaggggcccaaaggctaggacctcctttttggtgggggtgcggttggggtacttggtgacccgctgcccagttttcttatcggtgaccaccttaaccgagtacggccgcttgcggaccaccgaggtgatgtggacggtcgcccgcgacaaaccaatttcttctagcaacttgattaattccttacccgaagtcccactaaagggcacccggctatcggtctcactgcgcccgggagcctcacccaccagcattaccgccggatggtttggtccagcccccggtacaaagcccattaggggacgatccttgatcgctgcctctacttggtcaactaactgctgaggatactcaatttgcacgctgatcacccatcttcctatccgttatgacgccacttggtatcggttagtacccgggccgctacttgacccaggggtaaaaagaggacgattaacatcgcccgggttaaccactcggccccggtgttgaccgactgtaaccctaagttatagacggcccggtacatgtacagcccgggcaccatgattaccaccgagggaatcgtgatcgcaatccgcgggtaaccaacccggttacggacaatcgccgccaacaggccacaagctagcacccccaagaaggcggccgggccagccgccatcccaaagtcgactaattccagccgtaaggtgttaccaagcgccccgattaccccggccgtcgccgacattttcggcgtcgaattaaacataattgaaaagccaaagaccccgcaaaaagaggccggcaaccgcaacaataagagctgccattcatttaacggcaaggcggcgaagttggctggccttaagtggaccatcagggccaccagccagccaaccaaggtcgccacggtaatgattaacagggcgtaggcggcccgctccaagccggaccgcatgtctaatttggctaggtccagccccgaggtgatgaatggaaaaccagggatgataaagagcattgccccgatgtagccggcctcgtgacgttcgttgattccccagaagttttgcagggccataaacgggaccaggtataacaaacaagccacggccacggaaacggccacgcaagcaagcagggtaatgtgacggtcaatcatcttacgccgcacaaagttcccgcaccccgctcccacaaaggaacacaacatttctaccgggcccccgccgagcaagaagacgaaggctgaacaggccaaggccgccgctaaccccacttggtaagggcggtaattacccttcatccgttcaatctcggttaaacggtggtcaatttctgtaatcgtccactcccgcttgccccgctcaatttccttaacgaacttctccagggcgtttagccgggttgtgttcaccccggtcgtcggtaacgagatcgcctgggtgtaactgtggttatcatcaatgcaggtgtattcaatcgataccaagccaatatcggccgaacaggtcattccaaggttgcgggcaaccacgttcatcgagtcgcgcacccgccaggacccggttccgcaggccaaaatcattagaccaacccgcccaacgatcattgaccgttccactaagggggcctccttagccggggtaacgttgtcatcttctacaaaatcctgccacggaatctgcatgtggtggtggtaatcttcacccaccgcttgttccttatccatctttttctctccccactttaggcactaaattacgtcctattataggagggttgccgacgtttgtgtagggacaattaagcgggtgaaaagagttccaggtgctttagagtcgtcactagggtctgctcgtcttcgcttaacacgtaactttcccgggtcgccaccgagatgtaaaaactggccgggggcgggtccgtcaattctagcggtacgatccccggctcgtctttgatcgcatccaaaacgatcaggctgacgccgaggttttgacggaccagctccttgacccaagaaatattgggtagcgggtagagggtgctttccgggcggacacgggccgcatcgcaataagcgttaaaggccgcccggtggatgtattggtcactgtaattaatgaagcgttcgttagccaaatcgccaaaggccacccgccgttttttagccaacgggtgttgttcgctgaccgccacggtgaaggggcgcttggccaccaggtcgacaaatatcccctcctcattaatcggcgccatcgaccccaaaatggcgatgtcaatttgaccatccttgagccgttttaacagctcgtgggacccctggtcggtgatccgcaggcacgacaacaaatccggcggacaggatttaactaacccactgatgtatattttaccgatgatcgggggtaagccgaagcgaatgctgccccgcttagcctggctaattgacttttgcgccaaggctaactggtgattgatccggtccgccgcttggtaaagtaactgaccagcccgggtgatcttcatcccccgccggccacgggcaacgtcgaccaattggacgtcaaattcacgttccaggcgttggatggcctgagtaacggttggctgggtgacgccaaattgcccggccacttgggtgtagtttttcgtttcaacaacggccgtaaagtactgtaagtcacgcgtattcattctggcgttccccctttttcctccagattttaacacaaaagggcccccacggccgtgccccagtgaagtgaacccccgagattgttgtccaaacttgtgggttcacttcaagactcgcaaccgaatctgtgccttttatttattagtgttccttcaaaaattccatcatcagcttattaaaggtcccggcctgctccgccatcaccacgtggccggattggtcaaccgcctggtggctaacgtactccggattaactgccgccatcgcatcggcaaagtgaccatcaaagtagggactctggttcgccgtcaccaggagaaggggcacctgggcgttttcaaccgtcgtccgccaatccttctttgcgtggtcgtatagcaagggcaagttgtcagcccgcacaaagggaaacatttccttttctggagccagttggttcaagacctgcttgggtaccccgttcaacgtttcccggacattgccatgctccttgagtttgagccggtaggatgcccgggtgatgtccatgtagccatagggccattcggctgtatttagcatcttgggtgactggtcaatggcgattgctccccgtaccggaaagtctgggtaatgctggaggaagccgtatatttctgccgcccccatcgagtgcccaatcaaaaccggccgttcgatgttcaagccaactagcaactcatggaggtcatcaatcagcctgtccaccgaagccaggccagcagtgtgtcctgacgcgccatggttgcgctggtcatagctaaccacctggtaaccgtttgccagcaactcgggtacctggagacaccaaatttgctggtagccaccgaaaccatggatgaggacgaccggctgcccctggccctgaatccgataatttaaccgcacaccatcactcgtttgaaagtccatcagccagttcctcctttactaaggtcagaaagatcgtcacaatcagcaggtcggcggttccgccaaggctcaggtgcttagcagtaaactcctgctccagctgggccaactttgcccggcccgccgcggtcgtaatcccgcccgccgccagacatgcgtccacctgggtgtttttccgttccaaaatggctgggtcgccggcccgcttcaccagggtggaatcctcggtgtagcgagcaagggcaagcatcgtctggataatccgccggttccactcgccagcggtagcaagcatcgtcggtaagccatggtcaaataccgttgggtagccggcctgggcctcgccccgaatccccgtcaaaccgtactggcggtactggagttccccggctgtctgctggttcgttgccgcttttttttgcaagtcatcctgaaccaagccaacgaggagctgtttgaccgttgcttggatgtctgccagatcgacgcgaccattccgccgccagctatccgccaccgccaaggtcataatgccaagggagaagacggcacccttatgagtattcacatcgtgcgtcgccgtaaacatcgcctgttcggcccgcttgccgaattctcggagttccttaaacatcagcgggtaatcatccgggtgcccgttcagccccaattccgcggcctgttccaagtagcggcggaaactcagggagctattgataaaggtaaaaacgctcatgtcaggatgagcgccgtgttccaccggatccaccaagccaggcttgggccatgccactacttcgtacaagagtgattgctgggcaaaagctactaagcggtcacgcacccggcgccgctgttcgaccgccagtgccgcgctaatcaagctgcttaccgccgcctgcagttccgccaccgtatgccgccgcgaccgcccgcactccttcgccggccggccgcaaacaaagcaccgccgcgccggctgtctactgtccgcccgtgaaaggggaacaacctgcccagcccgctgcaccagaacatccaagtcaaagaggcggtgacttgcttgcccctcctcgaagcgggtcgtctgtgctttcacgtcctggggagctgccttgaccaggtagaagcgctcgggaccggttccggcatccagccactccgtatcctggcaaaagagctgacccgcggtgagccaatcacgttccaaggccagcagttccgccgtaaagaagcgctgaatagcccggttatttttgatgggtcccggaatattgagtttagctgccaccaccgtcatgccggggtgggccgctaccagccgttgttgaagggccgttcgccggtccttatttgccaacacagctggaatatcctgaggctggcccgttgcaaaaatgtttgtcattgtaggctcctttcacgtttgcgtgttctactatatgtattataaaggagttatgacataactcctattacttagataaaacataaacagcgcagtacacaaacggtctccagtgctcggcaaagccgaatcctggagacctgtttgtgcttgcgggggcgtgaaaacgaagtcataaatgacttctgtcacgctccctttatcaattattaagactaatccttaatctgctttacttcgtcaatcaaagttccgtcgcggtattcaaccagggccacagtccggtcagtgtattcgattggctttggcttgccaacgattccttctgcccgcttttgcagttcttcgattgaaaccagcggaatgcctggcgccttcttgaaggcttcaatgaggtccttccgtgctgggttaacagccaccccaacttcagtaaccaggacgtcaatggatgcccctggcgtggtgatggagttaacggcgggaacaacggtggcaatccggccccgggtcagtggagcggagataatcgtcatcttggcagtaccagcatcctggtgaccaccaacggcaccccggataaccccgttggaaccagtcagcacgttaacgttgaacttggtgtcgatttccaaggcggacaggatggcaacatccagttggtcaaccatcgcacccttgttgtcagggtcggcgtaccaggaaccgtcaatttcgatttgaccagggttggacttcatgctagaagcagcacccttgtcaaagtcctgcacgtccataaccttcttaaccaggtcttcttcaagcagcttgacgattggtgaagtcgttccaccacaagtaaaggcagcagtaacgtcgttgtccagcatggattgacgcaggtaacgggtaacggccagtgaagcaccaccagtaccagtctggaaggagaagccgttcttgaagtaaggtgagttaacgatgacgtcgttaaccatcttagcaatcttcaattccttcgggtccttagtgaaccgggtagccccactaccaatccggtcagggtccccaaccttgtcaaccttaaccacgtagtcgacctgggtctgcttgatggaagcaggcgtgttcgggtagtcggcgatggtgtcagtcaggagaaccaccttgttagcgtattgggcatccactagggcgtaaccaagggaaccaagggcggagtcaccttccatcccgttagcattccccatccggtcggagttcggaacacccaggaaggccacgtcaatcttgatgttgccgttttcgatggaacgcgcacggttaccgtgggaacggaagataactgggttcttcaataaaccgtgagaaacggcttcacccaggctgccccgcatcccagaactggtaatgttagtgatggtgccggccttgatggcttcaaccaccttatcgttcattacaccggtcagggatgatggtgccagggtcaggcccttgtagcccatcttgatgatcttgtccatgaccatgttgaagacatagtcaccgttccggaagtggtggtggaatgaaatcgtcattccgtccttcaggttgtccttaataacttggtctaaggagtcgaccagcttgtcgtcacccttggttacgcgaacatcatggcccgtgtagtgaaccgttgggtggccaatttcggtagtttcaaatggcttgtagttagttgagtttaagatttcgtctgagatttcacgaccgacactatttttcaatgtattcaccctcctcgttgattaggttggaagccttagctaagcgaattacccgttgtgcacgcaggacaactgggcggtcaaccatttgaccgttcatggaaataacaccggaacccttctggtgggcttcttcaatggctgcttccacgtccaacgcgttttcgatttccttcttggttggctcgtaaaccttgttgacccagtcaatttgccgtgggttaaccagggacttgccgtcaaagccgagttcgtggatgtgttcagtttcccgctggaagccttccacgtcgttcatgttggtgaagacggtatcgaaggcggcaattccagcggcccgggcggcgtggagaatcatattccgcgcaaattctagttcggcgccgtctgggtaacggtgggtcttcatgtcagtcgtgtagtcttcggcagacagggccagaccaatcatccggtcggtacttgcggcgatttctggggcgtttagaacacccttcgcgctttcgatggcagccatgacgtgggttgaaccaggttcgcggccaaacttcttttctgcttcttccactaccttgaccaggtcgagcatcatttgggcggattcaacctttggcaaccgcaccacttcgatgccggccttaaccatggcgtaaacatcattattgaagtatggcgtgtcaatcccgttgacccggataactaattcagagtcgccgtagtcttgggtttgcaatgcttcgtacaccagcatccgggcagcatccttttccgacatggaaacagagtcttccaggtcgaacataatggagtccgcaccgtaaataccagcatccttaaccattccggcgttgttccccggaacaaacatcatggtccgacgtaaacgttcttccattattaaaatacctcccagtctggttgatccgtagtttccagagcccgttgtgcggctgccatggcccgtgccttcacaacacagtccagggcccccttgtcaacggccttgacatttgcgttgtcaattccgtaggcgtttaaagtctcggtgatgaccttgcgaatttggtcgccgtacagctcctccactgaggaatccaggtcgatattgattccgttgtcgcccttgctcagggtgatttggatatcggatgattccaaagttcctgcaagtgcagtcttcttaatatccattattctaaacttccttccttaatgcgtgctctgagatcagaccagtgattttgaataaatgagagcgtcgtttgtggaacgtaatcttgcaccaccgctaattcatcgttagcaatcgctgctcgtaccttcgtggctgaaatcacgtcctgactagcattagcagcccggtccaggattttgacctcaacctcaggtggtagaaccctagttaattcttggttataaatatcagttgtcggcgagaacggctcgctgccgacgtagcgccgcgtgatgtttaacggcgcggcaatttgctccttaaagagggtggcgtccaaagcggcctgaaagtgggccacgttttggtcgtctttaaggaaataggccgggaacgtggcgtaagaaaccatgtagtccccgccagggaccaccgtcacgttgtccaggtcggcgcatcccgcctggactagctggtaacgctccgcagcggtaaagagcgaggcctcctggctgaccacgaaaacgtagacgtggtcgttttctttgctagcctgctccaccaggtagcggtggccgttagtaaagggattggcattcatcacgatgccagcaatttgactatcgtcctggtcggcaaagtgcggcaggtcctggatgtagtcgtgaacgtccggggttccattctccatgatggccccatcgtcaaccaccgccagggcgtgaaagccaacgtagccgaaactctgaacgtactggggcttggtaaagacgaagaggtggaagcggcccattgtcgccgcctcgttgaccagcttgctgaccagctcattaaaggtttccccatggcccttgaccttggaacagacggcgatgtatttcaggacgttgccagcaatcgagccggtcgccatgatctcaccgtcttcctcccagacgaaggttcgctcaacctgctgggtttcctttggtgaaaactccgtgattcccgtcttttttaagaacgcctgccacttggtaaagttccgcttgatgtgaatgttgatttcacgaacctgcatggtcgctcctcctctagttacttcttgctcgccgcgtaatccttgaccgcttgggctaccgtatccacgaccccgtcatcaaagacgccagggacgaaacggtcggctgtcggttcaggtactagactggcaattccttgggcaatcgccttctccaggccgaagtccaccttgttcaggtcggttgctaacaagcccttgtagagccctgggaagaccagaatattgttaacctggttcgggtactggctcgaaccggttgccatcacctgaacccccgcttcgtgagccacggcagggtcaatttccggcttcgggttggccaaggcaaagataattgggttatccgccatcttcttaacctggtcggcactcaaaacgtcggcgtcggacaggccaataaagacgtcccggttgcgaacggcttcgtccaggtcagcataagcagtttggtcactgctctgcttaaccaggttcgtctggtagtggttgtagttcttactatcagcgtgaaccgggccatcaatgtcaacgaaggtgatgttcttgattccggccgcgaaaagaaggcgggcggtcgcaacccctgaggcccccaccccgttgatgacgaccttcaagtcggtcagctgcttgccaaccaccttagcggcgttaatcaagccggccagcactacgatggccgtcccctcctggtcatcgtggtagacgggaatattaacttccttcgccagtttttcctcaatttcaaagcagcggggggccgcaatgtcttcgaggtggaagccggcaaaggactcctgcatgttcttcaaggtactaaccacttcatctggggaaacctgctcaacggtcagtggaatggcattcactccggacaggtccttgtataagagggcctttccttccacggtcggcaagccgccagcgggaccgatgtttcccaatcccaagaccgcggagccatccgtgaccagggcaaccagtttgccgctcatcgtgtacttatcctttagctccgggtagcgttcaatcagcttagaaataattgccacgcctggtgtgtaggcctcgcctaattcctgcttattgtggaccgcaaactccggtgagatggcaagcacaccttggtgttttgcatgaagcgataatacttcttcgtctttcatcattaacatcctccaatcactaggccctagtttactatcttttttaaatattgtaaatataagcgaatgcttttaaatatttaaaaagagcccaagcaaaattaaatgctataatcaactctaatagactttccacaaagcaggtgaaggattcatggacgcagaacacaaccagctcctggcaaccttagcgcaggactactacctcagtaagatggccatcagtgacatctccaaaaagtaccacctcagccgctacctcatcatgaaatacttagatgaagcgctggtctcggggattgtcagcatcaacatccacacagattacgaccgcaacgccaaactagaacgcaccctccaacagcactttaagattaaaaacctcatcgtcatcaaggacccgacgaatccccaagaccgcgaccagatcatcgcgacctttgcggccaaccaggtccaatcactgattagggactgccacacggtcgggctgacctggggagagaccatctacgccatactcgaccacttcaacaagcagaccgccagccagctgacctttacccagtttatgggcgaaaacatgcgctaccactcctcggcagcgtcgatgcagatggtccaaaaggccgcggccaagtacgatgttccctaccagacgattcccggcccgctgtacatcattaatgaccaggcacggacggacctttaccatgagccggcattcaccgcggcgtttacggcggcccgccggatggatattatcatttgtgggctcggcacccgccagtccatcaacagtatccccgcctgggcggagaatactgaccggattttccccggagtcgacctgggtaagattgccggtgtcgcctttggccggccctatgaccttcacggccggttcctggtgtcgccggaaaatgacaaaaccctttccatcccgctcgatcaaatcatgcaggttccccggcggctcgccattgtccagcgaaagtcaaagtttcaagcggcgcgcggtgccttagaagggaaactcttcaccgacatgattctaaccgagtcggttgccctgcgaattaccgacgctctcggaatttagaatttaaaaagtgacttagcaatttggtttttgctaagtcacttttctttttgactactgttgaatgattcaaaaaggcaacttaccaatccaactctttcagtagcaaacgattaaatttttaccagaggccgataaccttcatccacagggtaccgataattccgtataccaagaggtagaaaatccccatgatgaagttcatcttccaccattcggactgggtaacgtaacctgatgatgacagcacggaagctggtccgttggcatagtgagtagtagaactcatgaatgtggaagtgaaggccaacagcattgccgttaacattgcaggagcaccggcggcaaccgcaacggatacgaaggccgcgtacattgcggtaacgtgggcagtcgcactagcaaagaagtagtgagcatagaagtaaacgattattaggactgccagaacccaaacccaactgataccgtgaagggcagaaccgattgaaccagagaaccacttgataaagcctaacttggataattcatcagccatgtagaccaggacagacagccagatcaggacgttccaagcacctgtttcatgcaacaggtccttcgtgtccaggacaccggtaatcagcagcagggaaattgccaggaaggcaacaaaggtggcgtcgattgctggaataaagctagttaacatccagagaaccagtgtcaggatgaaaatcaagcccatcagcttttcagaaagcttcatcttgcccatcttgtctaactcttcgttagcccattccttggcgttaggcgtttccttaacctcaggcgggtacatcttgtagatgatgtatggagtggcaagcagacagataatacttggaacaacaccggcaacgaaccagcccaaccaggtaatgttgatgtggagggtcttagccagggcaacgataaccaggtttggtgccatggccgtcatgaacgttgcagaagtaatcaggttactgtggaattcagagaagaccaggaatgaaccaatcttcttccgggttcccttcttcgggtcagaaccgtaagtttccgccagcgactttacgattgggtaaacaaccccaccggcacgggcagtgttagatgggatagccggtgaagtaaccaggtcgattcccatgatggagtacgctaaccccaaactccggtgaccgaagctccgcacgaacaccagggcaatccggcgtcccaggccggtcttgatgaagccccgggagagcatgaaggccattgcaatcagccaagcagatgagttgctgaaggcggtcagggcccccttcattggtgccaagcccaccagtaccattaccgtgaaaccgactaaggtcgtcccggcaattggcaacggctgggtgatacagccgacgattgtggcaacgaaaatggcaaacatgtgccaagcagctaatgaaacgccatccggccgaattggaccgcagaaccacaggattaaaccaatggcgagcgtccaggcccaggctttagttttgaattttgataattccatctttcaattcctctttatattaagtctttcctctaatcaagttacagctcaacgccgtcaagaacttccttcatcttggcagccgaatgagccatcttcttactctcttctgctgacaggtcatgttcgataaccttcacgattccgctagtgttaataaccgctggaacacccaggtagaggtctgaaaccccgtattcaccgttcaacggtgcggaaattggcagggtcacgttgcggttttccaagatggccttcacaatgtaggccaggcacttggcgacgccgtagaaagtggcgcccttgcgtgcgataatcttgccgccccgctccttcaccatttcttcaatgccagcgtagttagctggtgtgaagttggcaacttctttaagcggctggccgttgaccgtagcttcatcaaaggccgcaaaggaagtgtccccgtgctcacccatgatgtgggcatcaatctcgcttaccggcacgtccaatttttctgccaaaattacgtttaagcgggcactgtccagtgacgttcccgtcccgatgacccggttcttagggaacccagacatccgctgagtcagagttgtcaaaatatcaaccgggttgctggaaaccacgaaaatgccgtggaaaccgctgtcgacgattggctgaacaattgtcgacaagatcttggcattcttgttaaccaggtccaaccgggtttcgcccggcttccggggtaccccagcggtaattacggccacgtccgcgtcggcagcgtcagcgtattcgccggaacgaataatcgttggtgcctccaaaggggtaatgtcttgcaggtccatggcatccccgtccgccttgtcgcggtttaggtcgacaatcaccaattcatcaacttcctgcgtcgtttgcagcagcgagtatgcaaatgacgaaccaaccgcaccatcaccgactaggagaaccttgtggcaacgtttaatcatatcgaattcctccctgaataaggttaaaaataattgcttatcaccggcaccagccacggtcccggtcaaatttcaagcctacttgaggctgcgggcgtagagggtaacctgctgcccagcctgccggccaaagataatcgtttcggcaatcgagttaccaccgacccggttattcccgtgtaggcccccggcaacttcaccggcggcaaatagtcccggaatcacgttcccgttgccatccaagacctctgtatgggtgttgatgtgtaaaccacccatcgtgtagtggatcgctggggcaatgtggatggcgaagaagcctggcttggcgatgtcgcggtccatcccggtcgtccggctaaattcctggtcatcgtggtccttgaccgcttggttccaggtcgccaccgtctttttcagggtggctggctccatggagagtttttgggcgagctcttcgatggtgttgccggaaaccactagccccaccttgtcgtagaagtcgacggccttggcccggtcacggatcccctggtcaaagatcaggtaagcggagtgctccggcaaagcggtgatggcgttggagacgatcttacgggtgtttaactcgttgacgaagcgttgccccttggcgttaaccaggattgccccttcgccccggacgacttcaccaatcaaataaacgtgcgggttatcttgttgaacggtcgggtggacttgaatcaagtccatttgaactagctgcgccccgacgtcttcgccgagtttcaggccgtcgccggtggcccccggttggttagtcgtcttgtaatcaaccaggtctgggcggtagcgcttcatgtattccttagaagcgccgaaaccaccggtcgctaggataacgctgttggccgcgatcgtcttggtgccggccgtggtttggacttcgaccccgttaacggtcccctgatcgtcttttaacaacttagtgaccttggtctggttgaagaccgggattccttgttggccaaccacccgcaacaactcgttgaccaagaatccaccgatcggggctaagctagccgggcggtgggtccgcatcaccgacatccccccggtgatcgtgacgtcttctaacttgatgtcgtgatcggccagccagtcaatcgccagggcggagtggtgaacgaagtaacccaagaggtccttatcgtttaaacgaccgccgtcttggtaggtttcccggtaaaaggagccgacgttatcgatcaccccgtgctttaattggacgttggtttcggcggcgttcatcccggatgaggcccggttagtgttcccacctaagccttcttctttttcaaggacgacggctgaaagccctagttcatgggcttggatggcggccgtcaagccggcccccccggaaccaatgatcaccgtgtcgtagcggtcctttaactcactggccgggcgtggttgaaatttttctcccataattccctcctaatcttgtttgtcgacgttggtcatctttaacatgtccatccattcgtcgtattgttcttcggtcaccttgccggacttcaaagcggcttcttttaaagtggagccggccttatcggcggcttgggcaatcttagcggcgtcgtggtagccgatgtatggcgacagggcggttaccgtcatcaaggagttgtccaaaagttccttcatccgggcgtcgttgaccgtcaagcctgcaatcatcttgtcggcaaagccggtgatcgtcccggttaggaggtcggctgattccaagaaggcgtcgatcatcaccggcttgtagacgttcatttcaaaattcccctggctagcggccattgaaacgaccgtgtcgttaccaaagacccgtagtgacgccatcgttactgcttcggcttgggttgggttaaccttccccggcatgattgaggaacccggttcgttggccgggatgtttaattcgccgtaaccagcccgcggaccggaggccaagaagcggacgtcttgggcaatcttaaacatgtcggcggccagggtcttcagggccccgtggaccacgtttaagccggagtggttggccaagccaaagaacttgttggtcttaaccgtaaattcgtgtccgtaaacgacggaaaccttttcggcgatcttttccggcatccccggggccgcgtttaaaccagtccccacggccgttcccccgatcgccagttccaatagggtcggttggagttgctttaagtagtcccggtcgtgttctaaagcggccacgtaaccagagacttcttggccaaaggttaacggggtggcgtcttgcaggtgggtccggccaaccttaacgacgtgccagtattgttcttgtttggcctttaattcgtcaattaggtgctggacggccggcagcagctgatccaaggcttccacggccacgatgttcatcgccgttgggtagacgtcgttggaggattgacccttgttaacgtcatcgtttggcaatacggtgacgtctggattcaagcgcttagccaggttggccacgacttcgttggtgttcatgttggtttgggtcccggaaccggtttggtaaaccttaagtgggaagtccttgcgcaagtcgtcatcgggcaggactaagagttggtcaatcgcctcgatgatcaactttcccttggcctcatcaatctggtttaattccaggttggcttgggcagcggccttcttaatgttgagcagggcgcggatgatggccaacggcatgaactggccggttgggaaattgtggcggctccgttccgtttgtggtccccagagggcttcttgtgggatttgaactggtcctaaagtatcttcttccgtccgaaattgtgacatattcttcaacctccaagtgattaatccgattgtatttgtgaaaagttacacattacttaacgattatacgataatccccccgctctcttatagtcaaacccgctagttattataaggattgattattattaacggtcctgcaccccgcttaattgatattcatcaactttaatcggcctatttttagcgggattgttagcgccttcatttatttgaattttgtctaatatccgtaattgcttgccaaatagtgacggcgagccacccgtaactttctaaatcaggatccctgattgattttattccaaaactatgtcaaaatggggacgattgttagccccttaacaaggtgacaaacacagaaatgagaggatttgatcatatgaagcactacattgggattgctggaaccaaccgtcaaggctccaccaaccgccgcttgttgcagttcatcaaggaacacttcgccgacaaggccgaaattgaattgatggacattggtggcctgccggtcttctacaagaccccggaccgctcagttccggaacgggtaactgaaatggccaagaagatcgaagcatccgacggggtcattatttccacccctgaatacgaccacggggtcccggccgttttgatgaacgccttggaatggctttcttacggtgtgcacccctttgctgacaagccggtaatgattaccggggcgtcatacgggatgcttgggacttcccgggcccaactgatgctacgccagatgctggactccccggaactgtccgcccggatcatgccatcatccgaatacatggtgggccactccttacaagcctttgacgacgaagggaacctcaaggaaggggccctcgtcaaccgcttggacggcttattcgccgacttcgacaccttcgtcgacgtcaacaagaacctggtctatgaccgtgaacacgtgatgcaagacatccgcgtttccgacctgaagaacgacttataaaccaaggaggaacctacgcatgaagttagttgggattgtcggctccatcgccgaagattcatacaaccgcaaattaatgacctttatggccaaccgtttcaataacatcgccgacattgaagtcgtttcaatcaaggacgtaccgatgttttccgaagacgacgaccaaaccaacgggatggccgttcaatacttgaagcaccgaattgaaaacgccgacggggtgatcatggtcacccctgaacacaaccacaccacgaccgccgctttgaagtcgacgatcgaatggctgtcctataagatccacccgttagaagacaagccggtcctgatcgtaggggcctcttacttcacccagggttcttcccgggcccaattggacctgcgcgaaatcttggaagccccaggggttaacgccctcgtgatgccggggaacgaattcttgttggggaacgttcgcgacgcctttgacgacaacggcaacttaaaggacggcggcacgattaaccgtttgaacaacttgttgatcaagttctccaagtgggtcaacgtcttgaaggccttaaagggcccagaaccggccgacgcctacaagaacgaagacctgactgcctccgggaagactgacaccactatcgaaggggtgaagcccggtgacccagactggattgaaaaggccgctaagttgaccaacgccgcttccggcaaggactacgttaagctcgacgctgggatcctgaccgttgaccaacttaactggttcttaaagtcgatcccggccgaactgacctacgtcgacgacaacaaccagttcctctactacaaccacaaggccccggctgaaaagatgtttgcctcccggaccccgcaacaaccgggttccccgatgtcggccgttcacccggacaagcggaatgtccacgaccacgttaagcaagtcatccacaccctacggaccggtaagaccgacatgttccaactggccgaaccagtggacaagaagaacgctaagtgggtggttaacaactaccaagccattcacgacgaagacaacatttaccgtgggattaacgaaatcgtgatcgacttctggccaatcgtcaagaagtacctggaaatgaccgggcaaaccctggttgacgacccgaacagcaaggtggacgctaacgccagtgcttctaccaaggaagaagccgccaccgaggctcccgccgttgacgctagcgccagtgcttccgaaagcgaaacggaaagccaaccggcaccggcaccggcaccagctactcaagcaccggccgttgacgccgacgccagtgcctcagaagaagacgcaccagcacaaccggaagtcgacgctgacgccagtgcaagtaaataacggaagtgcgcccaacccgttcggcaggccgtatggctaagctagggcaaatggttaccgccttagcggtgttctttacccgtacttagacactaggcctgcggttgggagcacgttatctgcggaagtgcatccctacaccctacaataagacccctaacgctcacctcgtgcgttaggggtcttttcattgtcgtttaagcaagggaggttggtgagcacttcctcttattcaaatctagccagttcctggtccagcggcttgtattccgcttgccaagtaaagtcggccaccgcctgcttggcatccgtgattcccgctgcggctaagccctggtcgatggcggattgagccaccgcctcagccaccttcttggagaagtcggctagcttggagaccggtggtaagacggcggcgcccggttgatcagcgtcaacgaggccccctaaggcgtgggcggccgccgccagcatgtcgtcgttaattaccttggcttggacggctaaggccccaaagcccacccccgggtaaatcagggcgttgttagcttggccaatttcgtactgaaccccttggtagtcaaccgccggggtcggaatcccagtggcgactagggcccgcccgtcagaccagttcataacgtcgtctggcatggcttcaatcttcttggtcgggttggagattgggaagatgatcgggtgcttagcgtgggccgccatttcgcggatggcggcttcggtgaaggcgttgtgaacggtcgacgttccgaccatcaccgttggttgtaccgccttgatagttgccgttaagtcggttaattgagcggcgttgtcgaattcaccccgcaaccgggtgaagcgggcttgttccggcgttaggccctccgtatcatcaaacaacaacccctggcgatcgaacaagtagaagtgctgcttggcttcttgttcgctgaggccttggcgcaccagttcttcgaagagcatttttacgatccccatcccggcggtcccagcaccaaaggttaggaaggtttggtcggttagcttttctttggtgatgtttaaggcccccagtaccccggccaaaacgattaccccggtcccttggatatcgtcgttaaaggtcaaaatcttgtcttggtacttatccaaaatcttggcggccgtcccacggccgaagtcttcaaagtgcaacaggctcttagggaagaggctttcgacatcgccgacaaattggtcaatgaagtcaaagtagcgttggccttcaatccgggcgtggcgcttacccaggtagttcttgtcgtccagtagttcttggttgttggtcccggcgtcaatcgaaactggtaacacttgggccgggttgatcccagcggcggccgtgtaaaccattaacttaccaacggcgatgtcgaccccattaactccccagtcaccaatcccgaggatcccctcggcatcggtcaccacgatcagacggatatcccgcccctcggcggcgttctttaagatctcacggttgttttctgggtgatcaacggttaggtaggcggcattttgcggcttaacgaagcgttcgttgtactcttcaatcgactcggcaattaccgggtcgtacacgatcggcatgaattcgttgatgtgcttgcccattaagttaaagaacagcgtccggttgttgttaaagatttccatcaggaagtggcgtttttcaatcagggtgcccttcttttggtagagggcgtaaatttcatcggcttgttcgtcaatcgtcttaacccgtggtggtaagagccctagcaggccgtgttgcttacgttcctcagttgtaaaggcggtgccccggtttaaaaaggggttgtttaacagttcgtatccactaatcattttgatcggtcctttcaatccatctgcacaactttctctctcatcgtggttgatcataagtagtcccttaggtgatagtcaaaccgatggaagccaatcaattttattgatatgataaacagaaacgccgttacttagggggggtaaagatgaacattaaggaacttcgctattatcatgacctcgtaattcaaaaaaatttttccaaagtcgccacccactttggcgttgcccaacccaccatcacgatggccatccaacgtttagaacgggaattaggggcgccgctctttattcggagccaatcccaccacgacctgaccgtaaccgccagcggtctgcagtttgaccagcacgtccaaaccatcctgcgcgaattggaggtcgctcaccaagagctttcccgggccaaacaggaacgaatccgctttggcctaccgccgatcatcggtaactactttttccccgcctacacccccgccctgctagcggcgggattgttacaacgcttagaggttgaagaccacgggtcccgggagctaacgaaaatgctggcccacggcatcatcgacatggccctcctagggtccttagcccccctacaacaagattctttttcgacgcaagtaattacgcgcgcccccatccaaattatcgtggcacccgaccaccccttagccacccgaaccaccggcgtttcctttcaggacctcaaaaaagagcccttcattaccctggccaacgagtacgttcacgcccaggccttccaccaggtttcccgggcggctggggtgcgtcccaaagttgtttttaaaacccacgacgttcacgttttaaaaaccctggtggcgaaaaactccgggatttcctttctcaccaccctagctctagaaccccaagatcaccttgttgcactgccactactcgatctgggcgcccccgaatttatcatttcggttgctacccgggccaaccggctactgtcggccccgggccaaaacttatggaatttattaactagcaaaggcaactaaaaggcggcccccaaccgggagtcgccttttgtcattccttaataaacttcgccgcttctttaagggcgtcttctgcttgaggggcgtagccgacttgatcgacaaagccatgggtaacgccgttataacgtaggtgggtcaccgcgacccctgtttgccttaggcggtccactagcttttcgttggacaagcgcagcgggtcaaactcgccggaaatcaccagggtcttgggtagacgttcgatgcccggggcgttgatcaccgcaatcaaggggtgctctaaactaccgaccgtcccaaagtacgatccccaggctaaggtatcactggaaaaggacttaaaaaaggcccgcatctgctcgccaaattccttgaactcgatcccggcactggtgtcttcaatctgggccccgggcacgtccgggtattttaagaccagcttttcaacccagttagtggcaaaaaccacccggtctaagtaggcggtcgtcagcaccagtcccccaccagccgagtcgccggccagcacgaaaccagcgggcgtcgtttggtaccagtcggcgtgctcgtgcaagtagtttaatacccggtaacaggccaggggggccgctgggaaggggtgctcgggggccagtgggtagtcgacgctaatcacttggcacccggcaaaatcggccagtgcccggcagagcatttcggccccggccacgctcccgccgtaataggcgccgccgtgaaagtacagcaccgttggcaacgtcggccccgccagcgcggccagccggtagcgacgggtcgctaccccgtcgataaccaggttttcaatttgcaacgagtgcttggcgatgtttttctttgaaccaggagcgcccatcatccgatcgcgcatgtcttggatactcggcttttcaaccgcttgagccggcgaagcgttaaatacgggcgccaagttcacccgggtttcgtcgcttaaccagccgcccgtcgtcttgcccggcacgaacttaacggtcatccccgcttgtttttggccccgctccaagctggccagtgcttcttgatagtccatgtctcctccaatcaaaaacgagcaaccacataggggcgcccgtcagttaattattcagcgatttcaacgtcttcaatcacgacgtcttcttctgggcggtcgcggaagtcgcgcttaacctgggaaatcttttgggccacgtccatgccctcgatcacctggccaaagacggtgtggtggaagtccagccacggcgtccccccctcttggtagcgggcgattacttcgtccgggtagccggcggccttcatttggcccaccatgtcagccggcacgttttcgttggtcacgatgaagaattggctcccattggtgttaggaccagcgttggccatcgaaagggcccccttgaagttaaagagttcctcggagaattcgtcttcaaaggcttggccgtagattgattcaccaccggccccggtcccggtcgggtcgcccccttggatcatgaagtccggaatcacccggtggaaaattacgcctttgtagtagccctgcttggccaactcaacgaagttcttcaccgtcttgggtgcttggtcggggaacagttgtagcttgatgtccccttggttagtcttaatggttgcttgaacggccttgacgtcggccaagttcagttgcggatattggctcatctttttcctccaaaattagtattagggtatattttaacacaataagggaagtgcgaaccagccattggcaggccgtgggttaaggatagaccggggattgatgcggtacgcatcgttctccggtcagacttagccacgttatctttggaatagtcaagatacaacaaaggcgccgcatggttttgcgacgcccttgtttagaagagagatgttgagatgtttagtttttaccaacgacggcgatcaggtcatctccggcctgaaccgtcccgtcagcgagctgtttaacggcactgtagttagcggtgttggtaattacaatcatggtcgtggtgtcgtagccggctgccttaacggcatcaaggtcaacggtgcccaaaacgtcacccttcttgactttttgaccctgcgctacgttggaagtgaagtggtcaccctttaagttaacggtgtccaaaccgatgtgaatcaagatctcggcaccgtccgtactggttaaaccgtaggcgtgcttcgtggcgtaggccaccgtgatctcaccgtcggccggtgcgacaatcgtcccgtcacttggaacgatggcggccccgtcccccatcatcttttgggagaagacctcgtcgttaacttgactcaaatcttcagcggtcccacttacgggtgcgcccagcgtttcggtcttagcggcttcaccacttggttggttagcactagcaacagttgctacggcttcgtttgcttgggtcgtagcatcaactgcatcagcgtcggctgcttcaacaaccgggtttaccaagtgattgtgcgtcttcccgtaaaggaaggtgatggtgaaggccaccacgaaggaaacgagttcacacagcaggtagaacggaattgacttggctccgatggataagaacccaatgaacccggccgaccccatcgaaacggcgatgacgtggaagagaccggctagagtagcggcggtcgcagacccgatcaaggcacagaagaatgggaacttgagcttcaagttaaccccgaagagggctggttccgtaatccccagtaaggcggaaacggcggcggaactagaaagccccttcatcttttcgttcttggttaagaagtaaacggcggtcgtggcagccccctgggcaacgttagccatggaagcaacgacgaagataaagtccccgtaaccagtcccgctcttgtaggcggtcaccagctgagtttcgatggctgggaaggattggtggagccccgtcaaaacgattggcgagtagatggccccgaagatcccggtcccgacaaagccgagggtcgagtaaagccaaacgatcccgttagtgattaagtctgatagttccttcataactggtccaaccacgataaaggtgatgaaccccgttaagatgactgacagcagtggcgtaaaggtgaagtcaaccgcggatggtaacttcttgtggaaccacttttcaaagattgacaggatccaaacggcggctaaggccgggatcacttgcccagtgtaagattggatgttaacggtaaaaccgaagaggtgccatgcacccccctctgccaaggccggcgccgtcatcatcatcccgactacggcccccaagaattggttggccccgaagcgcttagccccggaaacccccactagaatcggcaagaagacgtacggagcggccgacataacgttgaccattccttccagccccttgatggccgggaacatttggacgaccgactttggcccgaacagaccttgggaaactaaaacgttatctaaggccatcaacagacctccggcaaccagggccggaatgattggcacgaagatatccgacagcaacttaatgaaggccatcacggggttgaacttttggttcttggccgcgatttgcttcaagtcttcggtcgaaacttccttgagcccagtctgcttgatcagctcgtcataaacgttgttaacgtccccaggtccgatgatgacctggtactggccgttagtcttgaaggtccccttgacgccgtcgttgttgtcgagggccttttgatcgatggcctcatcgtctttgaggactaatctcaaccgagtggcacaatgggccgccgcaacaatattatctgccccgatggccttgatgacatcggtagcgacttgcttgtgatccataatcgttcctccatctgcaagtatttgataatgcgaacgctttgtaagcgcttttctaccttatccatcatacatgactattttaaattgtcaaccgtttgacatattttttgaaatcgctaccaatcgtgatttgatcacaagcccgttatgacggcatttcaagcacgtaagcgccgtcaatatttcctctgctaacccgtttcagagcctggtcagcctggtcaaatggcaccgccgtgaccgttggcgtgatccccaaccgatccgccagggtcaagaactcctcaccatcgcggcgggtgttagattcgacgctagtgaccgttttttcgtgaaagaggtggtcctggtaatttaagctggggacgtcactcaagtggattccggctaaggccagcgtcccgttgggggccaggttagccaaggcgttaggcaccatggcccccgccggcgaaaacataatggccgaatcaagcgggaccggtgctcggtcataggccccttgcgctgaggcacagcccaactccagggcaaacttttgggcgtccttgccccgggtaaagacgtgcacctcaatcccctgcttaatcgctaactgagccgccaggtgtgcggagccaccaaagccatacagtcccaaacggccccccgccggtacgttagcccgcaagagcgcccggtaaccaatgatcccggcgcatagtaggggcgccgcttccacgtccttaaagcgggcgggaatccggtaggcaaagccctccggtaccgttacgtactcggcgtagcccccgtcgtgatcccagccggtgtacagcgagtggggacacagattttcgtgtccactgcgacaataacggcagatcccacaagcgtggcgaaaccagggaatcccgatccggtcaccaatggcgaaacgctgggtgctagctccactagcgaccacccggccgacgatttcgtggcccggggtgacttccggttggtggacgggaaggtcgccttccatcacgtgtaagtcagtgtggcagaccccacaggccaaaaccttaaccaaaacctcgccgggcgccggggtcggcaccggttttttaaccaattgcaggggacagggatcactttcaatcggggcgggggcttttaccgcccaggcccgcatttgttcaggaatttgttctgacacagttaccactccttttagtttaattacgtttattatagcgcgggattaggagaagtgcgaacccacccagatactacttatcaagaaggtggtttgctattccacagataacgtgctccccgaccacgggcctagtgcctaagtacggcccgtttgataggttggtacacacttcctttatgccaatcgattgacagcggttgcgcaagggccctaaaataggggtaattttacaaaaggagcctttaaccatggaatggacccgtcaacaacgttaccaatcctacgatcactacaccgcccagcaactcttagaattgcaaagccaagccgccaccgacccggtgcaggtacgctaccacttgcaccccagtttggggcttttaaacgacccgaacggcttttcctattttaacggccagtggcacctcttttaccagtccttcccgtttggcgccacccacgggatcaaatcctggatgcacaccgtttctgaggacctggtccactggcgcaacctcggcttagccgtcgccccggacaccaagttcgacagccacggggcctactccggttcggccaaggccttcggtgaccggctcttcttaatgtataccggtaaccaccgcgacgccgactggaaccggatctcttaccaggtgggagcttggatggacaaggatggccaggtcaccaagctggaccacgagctcttcgttaacccgccccactttaccgaactccgcgacccccagctcctagttaaagacggccattactacgcgctcttaggcgcccaacggaccgcggataagaccggcgtcgtcgacctgtgggaaagcgaccaactggaaagcggctggcacgaagtcggtgaagttgacctggggcaatcagacctaggttacatggtggagtgccccaactacgtcgacgtcgacggtcgggctgtcatgatcttttgtccgcaggggctggatcaccaaacggcgccctaccaaaacatttaccccaacatgtacctgaccggtcaagactttgacctaacggcgccgcgcctggttaacccggacgaaacgctcaccaacctggatgagggctttgacgtttacgccacccaagccttcaacgccccggatggcactgcctacgccgtttcttgggtgggcctgcccgacaccacctacccaaccgatggccacaactgggccaacgtgatgagccaggttaaggagcttcattaccgcgacggccacctctaccaaaccccggtggaagcaatggccgacctgcgccacacccaccacgccaccatcttcaccggtcagccaaccgtgatcaaagaagacgccggccagcagttcgaactccaggtgacgatcgaaccaaaccaggccgggaccctgaccctagctggcgaccagagcctagagcacggcgtcttcctgaactttgacaccaccgccggccaactggtaattgaccgcgccaaggccggccagccggtggcagaagaccacggcaccacccggaccctaaccgtcccgggccaccaagaattaaagctcgacatctttgttgaccactcgctggtcgaaatcttcgtcaacgatggttacaaggttgccactttgcgctactttgccgaccaagcccacggccaagtcgccttcactaaccccaccaaggccaccgggaccctgtggccaatcaagccatactaaagaggtttgcccatgctcgttaccgatctcttcaaccaaaaccagctcagcccccacctctccaagcaggccctctttgacctgggggtggcgcgccagcaggccgttccgagccgcgaactggccgcctacgtgccggtcgatcgcaaccccttggacctgattgcggcgaccgaatcgcagatgctccccgacctcttggcgctgcgccaccagcgaatgggcgtctcgccctttacattctttcgtggcaccgccgagctgatggaacacgacctagccgaacagagccacagcggcatccaagtgatcatttccggcgacgcccacgtcaacaactacggcttttacgcctcgccggaacgtaagctcttgtttggcctgaatgattttgacgaagcccggattggtaactgggaagacgacctcaaacgcctcttggtttccacctacctggctggtcagtccaacggcttttcggaacgcgacctcttgccgatcctcaccaacgtaaccaggacctaccgccacggggtcaaatacgccaacgccctgaccttgccggagcgcttctacttctcctacgagatccatgacatgatggcgacgatcgaccggatcagcgacgatcaaccccacaagatcagcaccatcttggaaaagattctcaagaagagtccccagaaaaactccgaacaggtcatcgccaagctgacgaccgcggatgaagaggggcgccgctactttatcgaacaagcgccacgagccaagcgtgttccccaagccatcaaggaccaactgatccggggctaccaccgctacttgaaaaacacccgcgaggacgtccgcgtttacctgaccaactttaccgtggacgacgtgatccgctacgccgtgggggtcggctcctttggcacccactgttacctgatgctgttatccggcaacgacggtagccacctggtcttacagatcaaagaggccctgccgctgcgggctagcctaaccagcttgagctccgaccgtgacctgcggctggcccaggaacgctcggccggccgtcggatcgtcaccgcccaaaagaccctccagtcggcctccgatcccttcctcggggcctcccactttggtcaccgctcctattactttcgccagttccgcgacatgaaggagtcgatcgacgtcgccaagctcgacctggagtcctttggtatttacacggccacctgcgccttcttgttggcaattgcccacttccaaagcccgaccgccccaatgatcgcgggctacttgcaccaccaaaaaccagtcgacgataccctggctgattgggccgttcagtacgccggccaagttaaccgtgattaccaaatctttatcaattactaaaaggacccccgcaccgttcaatttgaacgatgcgggagtcctttttagttcctcaatgttagacaggacaaatgtttagatttgcgcaattgttgattcctgcataatcttagacgatttcacagataacgtgctccccaatcacaggccgtgggctaagtccagccacagaacaccgctggcgcgctaacctgtgtctaggccttagcccacggcctgccaaatggttgagtcgcactccctcttccaacggaagccaacccctacaatatattgatttagtcctctaatttggcgatttcacgttccagggtcttggcaaactcctcggtggccggcgtggtccgttcctcttgccaaaagaggtagtaatcacggtgcaccaaggtcccccccgccccgtggagcggcagtgacttgatcatcggtaagtttaggtttcttgagctaaccaccccgagctgatcagtaatcatgtagccccggttggcggccaccatcgtgtaggccccctctagcgtttgggcgaagacgaagtcgctcttgatccccagcgtttgacggtagtaattagcctcttctttttgctggctctccggcgcgatcaaaatgcaggcctgatcagttagatccgctctgccgaccgactttttgctggccagcgggtggtggctagagaagaggatcatcaggttggtagtgactaacttgcggttaatgtactcatcggacagggcccggcgttggtcggaaaagatcaggtcaaccttttcgtcgtttaagaggtcgtacaactcctcgtggttaccctggcggaggttgatctgaatcttaggaaagtgttggttaaaggtgctcacggcacgggcgatgtcgatcccggcgtattcacgtaagtaaccgaccgtcaggtgcgaaatctgacgctggccaacgatggtcgtcgccgcttctaattgagccgccgattccagtaagtccggggcgtggcggtacaggtattctcccgccgacgtcaaagaaaaggaacggttgtggcgttccaagagttggacccccagggaattttccaatgcttggatctgctgtgagatcgcagactgtgagatgtaagccgctgcggctgccttagtaaatgatcggtattcaacgaccttaatgaagtagtcgagttgttttagtagcatacaaacctcccccaatttcataaaaaacttgggtaactattctttttttagttccttcagtgcgtctttgagttcttttttcttatccttggttaccagcgggtaggctagcggcaggtgtgaaatctggtccactagcgcattggcaacgatgtagcgcgatgaccacttgtcatctgacgggatcacgtaccaggggctgtccttagtggccgtggcctggatcgccttttcgtaggcgtcctggtaggcatcccagtactggcgctcccgaatgtcggcggccgaaaacttccagttcttatccggaatttcgatccgggcggcaaagcgggcgccctgctcttctttggaaacgtgcaagaagaactttagaattttaaacccgttgcgggtcaggtaggcttcgtaatcacgtaagtcttggtaacggtccgcgtagaaactttccttaatgtctttaaccttttcgatgttgggcaggtgttcgctcaccaggatttcggggtggacccgggcgatcaaaacgtcctcgtaataggaacggttgaagatcccgatttgtccccgctccggtagctgctggttgatgcgccacaggtagtcgtgcaggatttccgtcgagttaggttgcttgaagttggccaccttgacgccgaccgggttgaccccggagaagacgtgggcgatcatgctatccttaccggccgcgtccatcgcttgcaaaacaataatcaccccgtaggtccgcttggcgtacaagatcttttgtagatcgcttaactgcttagtacactcccgtacccgctttttcagctcgtcggttgacagacccaggtcgacgttggtcggtgcctttttgattgcaaagtgatcatcacggtagcggtactgacggtagtccattctacttcccccattcaaaaaagcttgttaaacttacagtgaacaaccactacaccataaggaggtcgccatgtcacaacaaccatccgttacttcgtggcaaaccactgttcaacggcaagtcgaaaatggccttcccaagggttttaccctcttggctgctcaccagtcgaaggggagtgaaagtttgtacttcactgttttaaaagagggggtcgttttcgatttacgtttatcataccacccgaacgcccacccggtgaacggcttaattgactttgacctgcgcgcttttccgggcaaaaagtacttgttaaaagcgatcgcgggcgccctgtcaaaccggaccaatggccaccagttaagctatcacgattttgtcgccctcgcctttgttgaaaaggttagtcaagctagcggcatctacttagtcgcacaagaacacttactgtgcgccctttcaattccgcccctgctggaggcaaccctcttggaccagtgggcccgcaagtggttgctagttcgcttcagagacggtcagctcctcttatcgcacaccggaatggcgctattagaagcctactgggaaattgccgatgtcttcatcgacgaaccgatctgggatgacaacccccggatcgaaagcccggccgagttgattcatcatttttcctgatcatcgcttatcagattattattacagtcaacgtccccatactttgtgtgccatcgcttccgtccgttgcgaacgtagtcatcttcggaagcaaagatttgtaatagatccattaagttttcgcgtaatcgtttccggatccgtttccaatcagccatcgctcgcccccctttctatctacttatcttattataactaatctagcgaaaaataaaaagttcccgctcaaaaacgggagctttaattttaatctaagacatgttttcgttcagcgcgactatagaagatccaggccacgatgccgaagaagaccggtccaaaggcggtccaaaaggccgttacccagtcgccttccagtagcggttcgacgcaggtgaagacgatccccacggcgataactaaccaaacgatcgtggtaaccacccaggtggtggtcatgctcttgtaaaagacaaaggggcggtcgaggtcctttttcatcttgaagaacgggaacgccccgatcaaaaacaggtacggtgccgaagaggaaacgttcatcatatcggtcaaaatcgtgtagaaggtcgccgccgtgcttcccccaaaggtaatgaagaagacgatcaccgaaacgacgatcatttgcatccacatggcaaaggccggcatccccgccttgtttaagctcgttaacttgtccggcaagagccgcgggtcacacccctcgacaaaggacttgatgggcgagtaggtcatgacaaaggcggccccgagcccgccgaagacgtcggacagggcggtaatttgcgagaagacccgcccgagcgtcaccgaagtggcgtggcttaagcccaggtggctaccggctacgagccccatgttattgatcaaaacgtattcaacgttggccaggtcaacgcttttcttgcccaatacctcgtgccagttggtggtcaccccacacatgaagatggcgagaacgtacagcaaggtcataatcaccattccgatgatcaaagcgcgcgggaaggtccgttccggtttgtcaaccgagtcgatcaccccggccatcgtttctagaccaccgtaagcaaagagggcgtagacaatgaaggaaataatggcaattggcgatataaaggcgctgttgggtgacttgataaagttgaccgccgtgaccggttcggctgtggcgccgtgatccatgacccagatggctagtgaagccaggataaagactgcggcaatccccagggtgaagaccccgcagaccgaggcgaccttggcgatcttgtcaatcccacgactggacaggtaggtgacgatcgccaagaaggcaatttccatgatccccagcgtttggttcgaatcgaggcccaagaggtgccaggtctgggtcttgtcgcttccaaacaacatcgttgaaatcgacacgaggaagtactgggtggacgaaaccagccagaccacccaggccgacagccaaataaaggtcccgataaaggccggtttctcaccgacggagccccgcatccaagaaaaaatccccccacgagcagccttaaacgaggccccgtattcggcaaacattatcgccgacgggaggaagaataagatggcggtcacgatataccagatcatacttgcgtagcccatctggtagtaggccgtcaatgagttactaaaaccaaaaattgacgaaaagatcatcaggaccaggctggccgtcttgatcttcttcgttgaattttcttcgtccattggattaatccatcccctaatttagaattggggcaattatacccctttccgaataatctttaagtctttaatgacaatattaaagaaaagatgaactaacccttccaaaacgatgaatagtcacttttaaaaacgattatttccggctggaattctcatcgtttattaatcttaccctccactaggtagccgtcatttttcgtccctttttcgaaaatcgccgccgcatttttgggcaaatgtgctatactatctgagacgttccagattttcaacatttaaaagggagcgtggtagggagaccagaatcctgccacgctcctttttacattcccccaagtttttcttctaacttccttcgtactttgtgtgtatgattgggttctgagattcgtttaagaaagaagaattaacgccatgacacaacgtccgcaacggcagagccgctctgaggtgcgaccacgacacaggagtcatcgcttttacccccgcctctttagttttctctttattctggcggcggtggtgatgattatcgccatggtcaacggtaacggctccaacgataacggtcaatcaggaaacgcccttacaacagtgaaaaaacaattacttggtgaccgccttggcgatcgcctccaacaagcatggcaaaagcagttaaacggtaccgaccaaaacgtgtcaatcgccatctattcccccacgaccggacaaacttaccgcctgactagggcgagccacggtcaccagttccacaccgcttccacggtcaaggttggggtactgaccgccctcttgctcgacaataacggccagttaaacgacaccgaaaacaacctggcccaggcaatgattgagaactccgataacgacgccacttcgaccctctttgaaaattacattggtagcaaggagggtctgcaaaaagtctatgatgaaatcggtatgacccacaccaaggtacgtagtgagtgggggttaaccaccaccacggccgccgaccaggttaagttactcaacaacatcttttacaagtctgaccttttgtccgccgacgagcgccagcaaatttactctttgatggataacgttgaagaagaccagtcctgggggacctcggccggcgctgcttcttaccagcttaaaaacggctggctcgattacggtagcgaccagtggatcgtcaactcgatcggccacgttaccctgaagaacggcaccgactacacgatcgccgtttataccgatggctccagtacgatgcaagacggcgaaaccctgattgaaaacctggccaaggccaccgccaaggtcatgaaggacgcgaaggattaagtgcgagccaactcaacccaaagcaaaaatcccgccctaggtcaattctgacctgaggcgggattttattatctagaaattagcaggctgggtcgcacttcccataacgtgctcctaaccacgagcctagtgtctaagtacgggcaaagaacggtgctggcgcaccagccatttgccctaacttagccatacagctcgtcgagaaggttagtcgcacttcccccataacgtgctcccaatcacaggcctagtggttaagtctgaccacagaacaccgcgttccgcgctaacctgtggtctcatccttagcccacagcctgtttgatagattgggtcgcacttctttaaaaccaacccttattcttgtgaaccgtcttcgtcgcgtacaccggcaagtccacgtccggggcccccttcacgtgtacccgcaggacgccgactttttcgcccttcttcacgggggcgcgcagcttgtggccgccgatcgtccgcttgtttttatccaagattaactcgacgtcggccttcttgaggctggtgttcttggctaaccacagggtggtggccttcttgagggttaagccaaccgtcttggggcccttcttttcggcgtgggcgacggtgactgattgaacgcccttcttgaagtcgctgagcttgttaacggtcaggtactggtacttgtcgaggacctggccgatcattgcgtcggtgaccttaaactggttgttgtattcccccggcaccttcaaaaccactgtgatcaagcggcggccgttaaaggtcccggtccccacgaagcagtagcccgacgaatcggtcatcccggtctttaaaccgtccacctcaccatgggtcgatgcggcggcgttttgaggcagcatcgagttgatgttgaccatttcgtactgctggctgtcggacacttggaagttgacgaacttttgcttggtgatttccaagacgcttgggtacttctccactaggtaacgggcaatcttggcgacgtctttggccgacagctggttttccgccttcttggagacgtttttcaaccgcatctcgccgaggtcgccattagcgagaccaatcatgttgtagatcttggcgtcggtcaccccggcctctttagcgaccgcctgcatcttctggttgaaggcggccgtggaccccgccgaggcaagggcgagggcttccgccgacccgtcggccgaaacaatcatcattgattccaccaaggacttaacggtgtaggactccccctcgtttaactggacgttggagaagcgccagtcgttggcgaccttagcgacctcctttgagatcttaatcttttggtcccacttgagcttaccctgttcgatgtcttgttcgatcaccgctagggtcaggattttaatcaccgaagcgatcgggtagcgcttggtggcgttcttttcgtagagcacctgacccgtttcggcgtcaatcgtgatcgccgcccgggcgtcgacgatgctgctggcgttggcgacagcgccggcactagtggccagcacggtggtaaaggtgacgaccaccaacaagaggtggaagcagacccggcgtagttttctcatcgttactctcaatctctcttctaaactttagcaacaaaaaaacggcaacgttcaccgttcccgtcttatatattagcggatctgattgattaatagttattttatggaaaaccgttaataaactgtaatcttttcgcaaactaagcccgtggttcccggtttgggaagtgcatcgctaccggtcgccccggttgaccgggttggttgggggccggttggcgggccgccatcttcttttgcatctcgcggatcgatgcttcccggatctgatcggcctgcttctttaagtcggtgtcgctaccggactcgtaaaccgagaactggccgacgatctggatgtcaattaactccagttcgttaggcactaagaactcactcttgagcaggctagccaggtacttagtagcgtctgataggtcttctaagcgaccaaaactatcgccgtagtgcttcatcttggcggccttctcggtgtgccactggtagtactcgttaaactggtcaacaacgtggtttaaagagtggcggtactcgcggcggaactgcgggaccccctgcaggttttcggaaatgtacttctctttagcaatgaattccatattaaagccagaggggttttgccgaagctcctcttgggtttgcccctctggtttgggggtaatgtggaactgaattaagcgtgcgtccatgatttcacctcgttttgtattcccttcagtctactattagtgaccgggtgctgacaagggaggcgcccagttgtccatttgactttcccttactatcccttttcatctgataagttaatcaaaaaaattgctagatggtggtatgataagagaaacgctttcaggaggtactggttatcatgctcgaacactacttgattgggacctacacccaccacaccagccagggcatctactcggtgaccctagataccagcgcgggccggctgtcacccacccgcctggaaataccaattcaaaaaccgatttttatgacctttgctaacaacgggatcttgtacacgatcgaaaagctggaccaagaccacgccgccattacctcctttaaagaggaggggggccactttacccggctcagttcggttagtgccccggggaccacgaccgcttacttagccatcgatgaagaacgccaactgctcttttcggccaactaccacatgtcgaccgtcaccacctaccggcttgacggccagggtggcatgcaaaaggccgaccaggtgctcaaagtgggggcgaccggtccccgcccgcaacaagaactcccccacgttcacttcgctaacctgacccccgatcggcgcttggtgatttgcgacttagggatggatcaggtcaatatctataacctaaccgatcaggggcaactaaaactggtcaccacccaccaggatcaaccgggctttggggaccgccacctaaccttcgggcgtgacgggcgcttcatgtacctggtcggcgaattgtcctccaagctggaggtcctcgcctacgatcaagagaacggtgaactatcgtcaatccaaaccgtttcgaccatcccggccgactggaccgcccacaacggggccgccgccattcacgtttgccacagcggccgcttcgtctacgtttctaaccgcggtgaaaacacgatcgccgtttttgaggtccaacctgacggccgggtcaagcacatccagtcggtggccacggccggcgacttcccgcgcgacttctccttgagccacgaccagaagtttatgatcgttgccaaccaaaacaccaacgatttaaccctgatgcgccgcgatccggctaccgggcacctagccaccaaccaaaccggggtaccatgcccggaaccggtgcaggtgctgtattggaagtgaaggaagtgcggaccaaccattggcaggccggataacacccagaaattcaaaacgagcgcctaagagaaagtttgctcgggcgctcgttttagttagaaaattagttggtacaacagggtgctgatgataaaccaggccccggcaaagagaacggtgccggcaacgtcactgacgtggtgggcccgcaggatgatccgcgagctagctaccaatagccaggccacgcccccgatcacgatcaccggccaaatcggccatagttccacgaccatcaggtacagggtcgttccccccagtacgtgaccgctgggaaaggaataaccatcatcatgttccaaatgggcccccgggcgttcgcgcttgagggtctttttagtgatgatccctaacacgttgccgatccctaacgtccacaaaacccaggcggcggcctgttcttcgtggataaccaacagggcgacggtcaaaatcaagacgtaaaccacgaccgcccagggttcaccgacccaggccaccaggttccaaaagcggttgtcgggctggtggggcattttagcaaaggtccagtcgtcaaagcgggcgaccaggccgtggtgggccaggtccaataagagcaaccccaagaggaccaggagcccgattaaccaggccccccagtggggaatcaccgtcacgctcactggtcttcctccttccagtgccgggtttggttaaccttcatcttctcggcgatcgcttggtagggttcgagccccatttcatcgcacatgtaaaagaggtagatcaaggtatcggcgatttcttctttcaagtggtcgcgttcctggttggtcaacggcgtttgctcgtccttccactgaaagacttctaagacctcgctggcttcgaggttcaccgaaagggcgaggtcctttaaattatggtacttcccccatcccttttgggcggtaaagtcgcgcaggatggtggtgatttcttggtaatccataggtcctcctaatcgataaaggtgtggtagcggttatgttcaacggggtgatccaacagaaggtccattgccaaccgcggcaccccatcttgggtttctttttggacgctgttgttgaggtaacggcaagtcccgaggtagtaaaattcggtttcatcgatggcacccgacttctggacgaacagccgcagcttgtattcgccccccatgaacttcaccacgttggccgaatctaacttaatgtcggaattcttagtgtagtaatggagaacgtggtcattgatgaagcggttattgtaattgatctccttacgaatatttttggccttcttgtaggtgacgaagataatcgcctcttttaaccccgtttcttcactggtgaagcgataacccgacacaagctggccgttcatatcgtaagggttgttaatcagacgcacggcatcccgcctagtgtagcgttccccaatcgtaaattgttcgttggcctggtagcgttcggcccgcagtaggcccgtttcgatcgtatcagaccacagctggtaaaaccagccccgcttggtaagggcttgggccaactgctcccccatttggtagtttttttggtctggatcataattaaccagcgcaacgcccccataagaagctcgtgatgggtaggccctttcggcgtagtactggaggcttaacacccgccggaccgagttcaaggtggcttcgttgacgtaacagctagcctccttgagcgccctgacgtaatctgcctccttgaccacggaacgttgtagtaataaccgtagcaaaatcaattcgtggcggcgcttgccgtttaacaattcaacggagataagggacaaagcctggtcttcgtagtcagttacttcaactggctcccccatcttaagcaagaaacggttgtagttacggggcttgaccaccgtcgctaagatctgcggatcgaccgaatccatctttaaaaagtcgctgagcattgggattcgccccacccgtcgcttaatattttggtaggcgtcccgtaagttagccagtccgtctagtttgaccttgcttaaggactcgtaaatccgttccttagccacctcgtcaaaggcgatcgtcgacaggccgacggttggttcaatgtcgacggtatcgcgagcctgatccttggagtaggaattatccccggtcaaagcaatcgggatcatgtagttatttttatagttaccaatgaagtcgaggacctcgacgtactccttacccgggtacttgcgcaatccccgccccaactgttgaacgtagacgatcgccgactgggtgttacgtaggaaaacgacctggttgacgcagggaatgtcgattccctcattaaagatgtcaaccgtgatgatgtattcgataagtccgttttctagttcgtgcaccacctggcgacggcggtcgccattatcggcaccagacagggccttggctgggtggccggcagccgtaaaggccctcgccaacgcttcagcttcggccaccgacgaacaaaagaccaggccgtgcaagaccgggccggaatagccgtagtaatcggtctgttccaggatgtagttaacccgttccttactggtcaacaattccaccgcccgttgctcttgcttacgcgacggtttgctcccctgcttgcggttccggtactgatcaacttcttcttcgtattgatcagcaaaggcgtagtcggtcaaccccacgtaatgaaagggcgccagcatgttcaactctaaggcttgttggagacggatttcataggcgacgttatagtgaaagagattaaagatgttaaagtcgtcgctgcgttccggggtcgcggtcattcccaagaaaaactttggggtgaaatagtccatgatcctttggtagctctccgccccggcgtgatgaacctcgtcaatcaaaatgtaatcaaagtcatcgggggagaagcggtgcaggtgttcctcccgtgacagggtttgaacgctggcaaataggtacttggcgttcttgtctctggccccaccagtgtagaggccaaaattggctggatcaccacctaagatattttgaaaactctggcaggacttttgcaagatctgttcccggtgggccaagaacagcatccgcttgggcttggccgcccgaacgtcgaaggctcccaggtaagttttcccggtcccagtcgccgacaccaccagcccgcggtccttaccggccaggcgcagggcctcaatttcatttagggccgccgtttgcatttggtttggcttaacctgctgcgcctttcccggttcatccgacggcgtcacgtaatcgtgcaccgccctgttaacttggtggtccgcttggtaagccttgcggtagccgtccagccagtcctcactcagcggcttggcgtccctccattcggcctcaaagttttcctcgatttgacgggtgatctcaccgttattcagggagctgacctttaaactccactcgtagttttggtttttcatcagggcgctggcggttaaattagcactaccgatgatcaccgtttggtagtcgcggtgcttaaagaggtaacccttctggtgaaaacccttgacggtggcaatccggacctctaagttgtcgattttaagtagttcttcaaacatgtccggctggttaaattgcaggtaagtcgacgtcaagagccgccccttgactccccgggccgccaaggttctaaagagcggcttgaggttggagaccattgcgtcggtcacgaaggccaccgcaaaggcgtactccgtcgcgtcgtttaattctgaacgcagctggtcccagatctggttatcaaactggttcgttaatagcttaggcccgaagtcaccaattggttggaccccatcttggtcaacgtagccgtgcaaaagagaggcgcccatctccttagccaggctcccctgtgtccctaactcatccaataagtgatcgtaattaacatcttgatgcattcttttctcccattaaatagacagttgggttaagtcttcttgcccgatcaattccgcgatttgccgatccgtggcggcccagtctaacttccctaactgggtctgctcacaccaaacgaccttgccgtgcgccattagccgtaagtcctcgctagctaagcgcacgtagtaaaccgttagattcacggtcccaaagtcatactcatgcttaaaggtcggccccactgccgggcctacttgagcttgaaccgaaaactcctcctctagctcccgggtcagcgcttgctcgggtgtttcgccagccttgattttgccgccgggaaactcccactgttgaccgagaactcgtgcgtcggcccgctgcgttgccaagatttgattttggtcgtttaaaatggcggccccaaccacctgaatctgtttactcatcgttttcccccgttttctttcagtatagcaaagttaaatccggttcgattctctaccccaacatccacttggcaatcagtttcgccatctcctcgaccgactcgcggtcctctttttctaaccatgatttgatgacggccacgttaccgtaaaagacgtagcggcgttgatagtcgcgctgttcttgggtcatgttcttggggtgggtcttttggccctgggtcaagacgaagagctggtcttgaaagtcacccaggttgtcttgggcaaacagcaccaaaaaagtctggcgccgttcttgcacgtattccagcaccgcctgcatgatcgactccagggcggcccgtttgtcttggcactggccgtggttagccacgctttgttgcaggtcggtaaagacctcttcttctagttcccacatcacgtccatcgggttgccgtagtgggcgtaaaaggtcgaccggttgacgtcggccttctcgcacagctttttgaccgagatttcgccaacctgccgattggccatcagctcgatcagggcttctttaatgacccgcttggtgtatttgacccggcggttttcttctttttcagccatcttttcctccttgtttccaacataaaaacgactttgtgttggttttaaaacaaattgtcgtttcttgctgtgatcaccgcttgctcccctcactataatacagccatgtcattaacacaacactgtgttggaaagggagaatgaatatgacttcaagttccgttgatgtgcacggaaaaacctataaccgcatcctgctggtcatcgtggtgatgatcggctcctttgcgaccgttttaaaccaaacctttttagccaccgccctgccgacttttatgcgggtctttgacgtgtcgactgcgaccgtccaatggctgtcgactggctttttgctggtcaacgggatcatgatcccaatctcggcgtggctagccgataacgtcccgaccaagcgcctctacttaatcacaatgctgatcttcttttgcggcaccctgatcgcctttcaggcccacagttttgccgccctcttagtcggccggctgatccaagccgtcgggatcggggtcgtcttacccctgttacaaatcatgatgttggaaatcttcccggctaaccagcggggccaggcgatgggactggccggcatcgtggtcggcctagcgccggcggtttcccccaccctagctgggtacatcctggatcacggcagctggcggatcctgtttgggatgctgttaccaatcatcgccttcgtcctcttcggcgccctcttcttcatgaaggacgtcttacccggcaaacccagccagctcgatctttggtcgacgatcacctcatcgttgggctttgggagcctactctacggcttttcgaccgccggtaacgacggttggggcgacgctaaggtcctgatcgccctggccgtggggctggtcttcatcgccctcttcatccaccgccagctgacgatggagcgccccttcttggatctgcgggtctttttaaataaggacttcaccgtcggcaccctgctgtcgtcctttgttaacctctcaatggtcggcgttgaaatggtcttgcccctgtacttgcaggacttaatgggccactccccctttgaatcggggctgacgatgctgccgggcgcccttttgatcgggttgatgtccccggtcaccggtcgcctctttgaccagtacgggatccgcaacctagcgatcaccggctttgccatcttaatcctggggaacctccccttcatcttcttgagcaccacgaccccggaaatcctggtcgtcttcttgtacgccgtccggatgtttgggatttccctggtcttgatgacgacgatcaccaacgccatgaacgccatcccggtcagcgagtttagccacgggacggccgccaacaacaccttccgccaaattgcctcgtcgatggtcacggcggtgatgatttcaatcctgtccaacgtcactaaggcccacctacccggccacgccctaaagagcagcgccccgcttttgtacgccaaccgggcctttgaagcgaccctgcacggctacagcgccaccttcttgtttgcgaccctcttttccgttgccggcctctgtttggccctgaccctcaaaccaacccggaggtaatttgatgctgatcttactattaattgtcctctttggcgggagcttctttttcttcgccaacctacatccccaccgcactggggccatcaccagcgccctcttctttggtctgtccatctttttattggtcttaaacatgggcacccacctggggttgactaaaaccaccaacaacaaccgccaaaccattcgaccgacctcgacctcccagggagtccagctcctggtctaccagccactgggcaccaccaacaacgagcgggtttacgtatataacggcgaccaaaagtccccgctccccggcaaacggggcctggccaaaacgaccagggtcgccagttcggttaccaccactaacgctaagcacgccaccctgaccctaacgaccaccaagtacacctaccaaaaccagctcgctaaggtcctctttgccatccccggcaccaagctcgcgaccacccagcaagtcgcccacttcacggtgcccaagtcctggttggtcttgtcgagcaaacaagcgaccaggttaaaacaagcagccgctaaccctactaaccaggccaccttaaagacccaggcgaccgcctacgttaccgcccacgtccaaagcgacctgaaagaactggcggccaaggcccaggccggtgaccaagcagcgcaggctcagttggctaaccaaacccagctgacccaaagtttagcggccaagtaccaacgcgccttcacccgccaggcactcctaaaattaagtagccattaaaaaaaacggggctgaggaaaccatgctccccagccccgctctccgcccgtaacctgcgtggttaactaacccctcccggtggcggaagcaccaagccggacccccatccggcttgatgtctttattattacaggcgacttggtcatatattgtcgttggccaaaaaaagcggtaaaatttttctaaaaaggatttgatcatatcgataaccgccaagccgccattattttcctcctcctaaccaccggggaggccaccaaaaatgacctgattgataagtaccatacctcggccaagacgattgaacgagacatcgccgccatcgaaacgctcctcggcgactaccttaacttagaggttaaacgggaacgcttcgtcaatgacgacggcgagcgcgacgtcaggtacctggtcgacgctagccaggggccctttttaacccagcgggaggtcttcatcatcgccaagatcctcctggccagccgctcctttgataaggaagtcgtcgaacacctcattaacaagttgacccgccccttaaaccagctccaactcgccgaacacggggccgacgaaattaacaccttgttaaagggggagcgccattactaccgtccggtggccgaaccgacccagctggcggtcttagaaaccttcctcgacgccgtctacgcccacaaaaaggtgatcgttgactaccgtaagcgcgacggttcgatcgacaaggactacgttttcaccccgctaagcatcgaacacttcgattactactggtacgtccgcggctacaaggaggtcgacaccaccaagggcgctaagggggatgaggccgacgctgcccggatcctgcgctgcgacggggtattgtcgatcaaaatcggccccgacgccaccaagcgtgagctcgagggctttgaagccgaccgtaacaccgtgatcggtatgttcaagggcaaaaaccaccagacccaaaccatcctggtcaaggccgaccacaaggccgccaaaatcacgatcgaccgcattaacgccgaggtggttggctactacgtcgaccaaaccgagttcccggcctcttctttagccgaagtgcccgatgacgcgccggtcaagttaaagtcacgcttaatgctgggcgccggcctttacctcttgctgggaatttccggcatcgaggtcttggaacccaaggaattacgtttagaaattatcaaaaaactctccgacaccctcgcccgttaccagctcgactaaagattgttacgttccgcacctaatttcttgacgtcgtgtcacttacttttgtacaataaccgtaatcatccacattaacccttgaaacggaggtacatttccatggcagataaggtgtttaccctcgcggaacttgctcaatatgacggtcaggacggtcgcccggcttacttcgcttacgaaggccaggtgtacgacgcttcttccatcccgaactggaaagagaacaagaaccacggcaaccttgccggtaaggacatcactgacgccctcaagcactccccccacggggccggagtcatcgaaggcttgctagtggttggtaccctcggttaaggttacaaaaaagacccggcagtgaagtgccctagaattgttagacacacatctaacgattctggggcacttcacagtgcgccgggtctttttttgagtgcgaaccaaccattggcaggccgtaggctaaggatagggcacaggttagcgccctcggcggtgttctgtgtccagacttagccactaggcctgcggttggggagcacattatctgagtaaccatcaaggatcaaaaagggctaggggaaaaacatctctcctgaattttttgtttgcttggaaagccggggaatctctcgttggcttgattgatgataagtttttgtccgaaaaggcttgtcaatcatgacggcgcccttgcataatgttgctatcgaataagggggtggctagccatgacacaagaaggaaccgacctggcaatcagtacctgcctactggcggggcagatcctaattgaaaacgggtcaaacatggagcgggttaatgacacgatgtaccgaatcgcggccaacgccggtctgcagtcgtttcaagcctttactacggtgaccggggtcgttgcctcatcgaatcaccgctccaacgcccaggtagttgacgtccggatccgccgcaacgacttaactaggattgcccaggtcaacgccatttcgcgggattttgccgaccgtaagattgacttgcgggcggcctaccagcgcctaagcctcgtcgatcaaatttccactaagcagccggccttgttacagtgcttagcagcagcggtgatgagttgtgtcttgatggttgtctttacgggcgataccaaggatacgctggtggcctttttggtcggcggcttttcctactgggtctacctgtggttggttagtaccttcaaggttcgttacctgggggaattttgcacggccttagtgattggggccctagccagcacggcggtccaccttggctttgcccaccgggtggacgacatcatcattggtgccatcatgtctctggtacccggggtgccaattaccaatgcggcgcgcgatattgtgtctggtaacgtaatttctgggatcgcccgggcactggaagccgttctgacggcggcttccattgggtgtgcaattgtccttgtcttacggtacttatagggggtggccatgattgaacgactcttgctccactttgtttttgcctttgtggctacgatttgctttgccattttacttaacgtcccccggcgcgcttacttagctgggggcgtaatcgggggggcgacctgggtgatttacgtggtaatgtactttcacctgcacgttggcttagccctttcaaacttgagcgccgcgattttaatcgggattctcgcgatgatggcggccaaggttcagcaccagccaatgattttgtataacgttccggccctggtcccctttgtgcccggtggccaggcgtacaaggtggtgcgttactttgttttgggcgattacgggctgtccttatcttacctttatcaggtggtcgtgattgccggggcgattaccctgggctttgggctcggtgacctaatcaacaccgctttgtacggtcgccaccgcaaagaggcccggccctttagccaactcaagggctggaaaaaacgtgattgagattctacaacgtggtatactcagcacatactttgcaaatggagatttattaaaatgctaattgaacgagatcgcaagcgtcccatgcgcttgatcgtgacaaccgtcatttttttggtggtagctgcgatgatttacaagaattcgatgctgatcacaacggtagacacggtctgccaggccctctttacctctagcaagacgaccggttttgtccacaccctaatggtgttgaccgcctttttggctagcccgaaaatggatatcctctggggcttaattattgcctttttcctctggggctttaaggggaaaattcccgcggtttgggccctcttgaccctatttgggggtgacgttttagggaccatcgtcaaacacgttattaagcgggaccgcccggcccaacacccggtgtctgacaccggctactccttcccgagtggtcacgttttgggcttcttcttgattgcggcgatcattagcctggtcgtggtaccgttgattcggagtggggccacccgggtaattattcaactggtgttgatctttgcggtggtcctcgtggcaatctcacgggtatacttgcaggcccactacccatctgacacctttggcgccatgctgttggcttacgcctggctacaattttccgaaggggtgtacgttcggtacgccccacggctgcggcggtggaagatgacccataactcttggtattaaacatgcgaaaaaacaacaagaggctgtgagaaaagcgcatttctcatagcctcttactgtattcacgaatgttagatagaaaatgcggggaataaccacaggcctagtgactaagcaggccgcagaatggtgtgtgccgcatcaaacgttcggccgattttacgtacgacccacagcggatgttatttctcacccaccccttgtttaattttccgccgttatagggagagtgtttgggtgagccactcatcggcaagggtgacccagtggtgaacgtggggtttgtgaggttctaccgtgggtccaaccagatcggttgccacgtccatggcgtggggaccgccgtcaaagaggtggatttcctgggaaatattttcccgttgcagggcttggacgtaattaagggagttttgcaccgtaatcaaggggtcggtaaccgtagcccaagtgaaggtggggcggtttgcttggttgacgtggggactagcgttatatttggccgggtcgtcggtccacttggtaagggtggcttcgtctggaaagcccaggtcgaggtcaataaccgggtagccgaggacggcggcgtcgaagtgacgctcggcctctgttaaaccactctcttcccctaaccaggttgattgccagtagtcgttgtagagtgccactacttgacccccggcggaaaaacccattacggcaaccttgccgttcaggtgccaagaatcttcgtgatggtgaaccaagctcacagcctgggccaaatcaaggagcggggcggggtagaggggcgtggcctcgccgacaaagctgtagcgcaggatgaagacctggtagcctaaggcagcaaaggtcagggccgttttttccgattcttcttctgggatgtgggtcattgacccgcccgggacaaagatcagggccgggaatgcttgaacgggggccttgggggtgggggtctgcaggtaagcggtcaggctcgcttgggttgtttgcttgccgttggtcagtgaaagtgttttaatttccataacaaacttcctttctgtaatcataaatctatggggtaattatagtgcaagcagatccacaaaaacagttagacatccgcttggtgaccgaagcggacatgggctttgttaaccaatggttttccgacccccagctagtcaaagaggtgggtcttaccctaagtgataatccaagtgcccgccaatgggcctttgccatgtggcgccagtcgggtgacttctgggtaattaccctaggtgatagtcgggttggcttagcgactagtttcgtgattgaaaaaggggttcgtgaagtgggctacttgatcttgagaccctggcagggccaagggctgatgactagggcgctgcaaatattaatttctaacttacgggccggggggcaaacgaaacgggttgaggcgcaaactcggggcgataattacgcttcggcaacggtcttggctagaaatggatttataaggacggctgaaaatgaggtggtcgttaactggtgcttagaactttcttagaaaaggggttgccatcccccaatccccgttataaaatacttatgtttatcacacaagaagaggtcgcacgactcatcagtatggcgggttaggcaagcaaatgccccagcccgtttgaaagggtgtcgtgccgaaacatcggtaattttgctgttgcctttgttgggacgtggcttaagaggccacggactgtcgcagtttgcggagtgcttccagatactaattcaaatcatgagttgggtcttctagcacttgctagggggccctttaattttgccccacctctttagccatataggaggaaaaatcatggatgagcaacaatcatctggcacacaaggcggccacattgaacggacgctaaagacgcgccacttaacaatgatcgcgctcgggggatcaattgggaccgggcttttcatcgcatccgggtcggcaattaccacggccggaccagggggcgccctgattgcctacgcggtcatgggggtaatggtctacttcttgatgaccagtttggctgaaatggcgacttacatcccgctgaccgggtcctttgccgcctacgcaagtaagttcgtctcgccggcaaccgggtttgcactcgggtggaactactggtttaacgccgctatcacggtgccggtggaaatcaccacggtcgggttagtgatgaacttctggcttccccacgtaccggcctgggtcttttccggggtcgcctttatcttgatcttcatcattaattacctgtcggttcgttcttacggggaaacggaattctggttagccttgatcaaggtggtcaccgttatcatctttatcatcgtgggggtcttagtgatcctcgggatcatgggtggccaaggaccaaccgatttgactaactttacctacaagaaggcgccgtttgttaacggggtacccggcatcatcaccgtcttcttggtggctggattctcctttcaggggaccgaaatgatcgggatcaccgccggggaatcggaaaacccggaaaaggcggttccagaagcgatcaagtccaccttctggcggatcctcttgttctacattttgacgatcttcgtgattgcttgcatcttaccgtacaccgatccgcacctgctgtcgtctgacgtgcaagacatcgtgacctcaccgtttaccctgatctttaagcgggccggtttagccgccgctgcgtcggttatgaacgccgtcatcctggtggccgtcctttcttcggccaactcctggatgtacgcatcaacgcggatgttgtactcccaggcccgggaaggttacgcttggaagatgtttggttacgttaacaagcacgggattccgatttacggtctgttagggacgacggtggtcggcatcctggtgtgggcaacccaattcattggccctaacgcctacaactacttaatcagtgcttccgggctctgtgggtttatcgcctggttggggatcgctatttcacactactgcttccggaaggccttcttggcccagggacaccaactgtccgaactcaagtatcacgctaagtggttcccgtttggtcctattttcgccttcgtattatgtatcgtcgtaatcgtggcccagaacctgagtgcctttgccaagttggattggtccaacattgccatcacttacatggcggtgccgatctacattgttttgtacctgtactacaagcttcgttacggctctaagatgattaagccgactgacgccgatctttcccggtcgaccaagggggaaagctacgagccaaccgaagataagtaagttaagaccgaaaaccaaggggcgttgtattttcaaccacccttggttttttcttttcaaaaatgaccgcgggggtgttagaatagtccttgtgtcttttgaaacggaacgaataagtgaggtttaacggatgattgtattagccggaacgattggggcggggaagacgagcctgacgcagatgctcgccgaccacctgggaagtaagccgttttttgaatcggtcgatgacaacccgatcttgcccctcttttacaaagacccgcaaaagtacgggttcttgttgcagatttactttttaaacaggcgcctagacgaaatcaaggattcctttgataacgatttgaacgtgttggaccggtcaatctttgaagacgccctgatgtttaagatgaacgctgacttgggacgggctacccacacggaagctgatatctacacctccttgttggggaacatgatggaagagttaccagatcaggcccaccaaaaggcgcccaaccttttgatccacatccgggtctcctttgaaacgatgctcaaccggatcaagcaacgcgggcggtcctttgaacaaatcgaaaacgacccgagcctctaccagtactacaagacgctcaaccagcgttaccaatcctggtacgaggcatacgataagagcccgaagatgatgatcgatggcgaccagtacgactttgtggcggatccgcaggcggccaaggtcgtcttggaacaaatcgattcaaaactttctgcattaaatttaaagtaatgattgacagtttgactgacatcgcctatactatagaagttgtcagttaacatggaggattagctcagttgggagagcgtctgccttacaagcagagggtcacaggttcgagccctgtatcctccattttattagggcgtccgaggggatcgtccttttattttcgacgtttgtcatgcggatatggcggaactggcagacgcgcaagatttaggttcttgtgtctttatgacgtggaggttcgagtcctcttatccgcattgaccaaccaacttaattattttaaaaaagtaattgacaaagttggtctagaagagtaacatatataaacgttgaaaggcgagtaattgccaatcaccccgaaaattgcggaagtagttcagtggtagaacatcaccttgccatggtgggggtcgcgggttcgaatcccgtcttccgctttttcttacgcacccatagcgcaattggatagagtgtctgactacgaatcagaaggttgaaggttcgactccttctgggtgcatacctcgggaattagctcagcttggtagagcgcttcgttcgggacgaagaggtcgcaggttcgaatcctgtattcccgatcgttattccccaaaaggcgccgttgaggttatcctcagcggcgtctttttgtgttgaaattagtggttaacccaaaacgtcatgattataatagcggtaacgcttacagtaattgaaaacgaaaggatggtgccattatgacgggacgtttaacgggtaaggtcgctattgtaaccggggctggttccggaatggggaaggcgatcagccaactcttcgctaaggaaggggccaaggtggtcttagcagacatcaacgcccaagggatcgaagaagttaagcaagcgattgaacaggcgggtggctaagccgctgctaaggtgaccaacgttgtgaagcaagaagacgttgacggggtgattgactttgccacccagacctttggccaattggacatcttggtcaacaacgcggggatcatggataatttcaccccagtcgggaacctaaccgacgcagaatatgagcgggtaatggccattaacttgactggccctgttaagctatgtcaggcggccattcaggtgatggaaaacaagaaaccggcggggtcatcattaataacgcctcagtcggtggcctcttcgggacccggggtggggcggcttacaccatggctaaacacgctttggtggggttgactaaaaacatcgccgggacgtacggacgctttggtaaggtgcgggccaacgccattgcaccaggtggggtggctaccaacatccaaaccacgattacagcaccggacccactggggatgcaagccccgcaggccactggtgagcccccaattggtcaaccgggacaaattgccaacttagccctcttcttggcctcagacgaagcaagttttatcaacggcgacatcgtcaaggccgatgggggttggacggttaactaactgcatcaaaaaagaccggctggtaatcacagccggtctttttgatgcagttaacggattagtgggctaacagggcgaagtaggcaatcacgatcaccccgaggatgatccggtaccacccaaaggccttgaagtccttggtcttgatgtaatttaacaagaaacggatcgaggcgtaggctaccacgaaggaaacgatcaccccaacggccaagatgaggccttggttgccggccagggtcccgccgtgggcgaagaacttgtacaacttcaacagggaggccccgaacatggtcgggatcgccaagaagaaggagaattcggcggccacgtagcgtgaagtcccaatgaggatcgcccctaggatcgtagctcccgaccgcgacgttccggggatcaaggagaggatctggaagcacccgatcagaatggcaaccttgtaaggtagggtgttgagtctgtcaaagcggggccgtaggttttggttgtggttttcgattacgatgaacaagaccccgtaaacaatcagggcgatcgaaaccaccagccagttcatgaggtgggcgtccatccagtcgttgagcggtaagccgatgatcaccgaaggaatcacggcgatgatcacctttttccacagggtccaggtttgggaccgttccaagcgggactttttcggtgaccaggggttgagtttgtggaagtacaagaccaccaccgccatgatggccccaagttggatcacgacgttgaacatgtcgataaacttcttgggttcgttgagcttaataaactcatcgacaaggaccaggtgaccggtcgaactgatcggtaaaaattcggtgatcccttcaacgattcctaagatcagggctttcagtatttcaagcacagcatatcctccttgcgccccgactactttaaaggggcgccgcaaatttattcagctaccattatagcaaggggaagaggagctatggtcagtctttggtaaagttcttgtaaattttggtccccggtaattcaaactgccccttttcttttgggcggaagtgtggttgacttagggtaacgtaaatatcagaatctgtctggggtgctattgatttagctgagaaatacccattgaacctgatctagttaatactagcggaggaagacagttgaatcaacgggatttccccgccattccagctcttctgcccccggacagaagggctttttttggagggaaaaccatgaagcatctcacactcaaagacattatcttcatcatgttgatcgccctaatatttggggcgctctttgtcggaacagacgtcatttacgccccgctttacctcgtgatcggtccctttgccaacgaggtcttatttggcctttggatcatggccggaccactagcaattgccattctccggctcccggggacggccgtgattgggaggtgttagccgccgtggccgggagtgaactgggctttttaaccctgcactacaagaactggggctggccggcgctgatttcatcggccttttgggtcacggtggtgtcctttgcctacgaaatctttaagcagggttacattcacttagctctaccgatgattctcgccctgttttgcacccggctcgtttccgaccttttgtttggggccgtcttagtccactacgttgtccgcctcttggtcagggcgcacgccattcaaccagcctaactaaagggggagcaactaatggagccaaagcaaacgcagattaaaaagttggtgttgaccgccctgtttgtcgccattgctacctacggggggagtctcttttcctttccgatcgggatcgctaagtgcgcaccggtccaaagcctggtcaacgtcttgagtgggatcatcctgggtccctggtgggcacttggtcaagccttggcaacttcaatcctacggaacctgctgggaaccgggacggtctttgctttcccgggtagcatgagcggcgccttcttggccggttggttataccagaagttcaaaaaaccggtcctggccgtcctcggggaggtggtcggaaccggcttggtgggcgccctagtggcggtcccgctggcaatgcttttattcggtaagggtggtttaatgttatttatcccaagcttttcggctagtgcggtcgttggcgccgcactggcctacgtcttggtacgggcgctatggccagtcatttcccgggaaatagagcggggctaaaggtcgattaactgacggaactggtccggcggggtttgctgcttaagttttaggtactgttcgtgaatgtctggttggacgacgttggtcccctccataaagtggacggcttcggtcccggcctgtagagacgttttgtagtaccactttttgaagcgcaagaaatcgagttgttcttgcaattcggccaccttagcttcgatgaccgtttcttcttggtctaggtaatcgtagcgctcggcaagggtttgatccccttgcatacataagttgataaagcccgcgatgtctttaaccgggacaccactcttcttgaggcagttaatgaccttcaagaagttaaagtcgttatccacgaaggcccggcgcccattctggtcctgtttgacgaaggggaggagaccgtttttgactaactacaacctaacgatcttagacattgccaaggtgacgattggcgaccacgtgatgattggccccaacgttgatatctatacggttaaccatccccttgataaagaggggcgccgccattatcacgccacggccttaccggtgacgatcggcaacgacgtttggatcggcgggaaagcaacgatcttgccgggggtgacgattggtgataacgtggtggtggccgcgggtgcggtggtgactaaagacgtccccgctaacacaattgtggccggggtgccggcccgggtgatcaaagagcttccagaatagtggtatcatagatccaaaaaggagtgcctaaaatggacctaactgctaagtaccgagcaattaatcaacggggcacggaactattgctggcggggggcgacattgatccctggttaagtgaccgggcagccgatcgccggcgggggttaagcctaatctttaccctgccggctcacgttagccgtaacattagtttcgccctggggaagttgcgtgaggttgagcccgggcaatactactatcctgctcaagacatgcacgtaaccgtgattgatttgatccgggcgacgccagactttgccctgactccagaagaagaggctgcctacgtttccgccgtcaagttagcggtggaaggggggcacccctttgaagtggccttccgggggctggttgcgagcggcagcgcggtcatggcggctggcttttaccaaccggggctagcggacttgcgccaagcggtccgccaccacttaggggtgcacaagcttcaattaaaggagcgctaccagcagacgactgctcacgtgaccgtcgcccgccaacaagcgcccctgattgatccgcaccaggacctcgctaccttggcaactttagcgaacctcaactttgggacgctggtggtcgaccaggtggaactagtggttcacgattggtacaacagccgaaaacgggtgttggcaaaactaagcctataaaaaaaccggccagttcgcaaaatcgcgaactggtcggtttttaatttgccagctacttgctttaatcaaccgtcacttcggggtgatccttagttaaaatgaactgttcgctgggggtaaccttaaagaagtcggccaccagtttactcagttcggccattgcttcggttgcccggacggcttgttcggcgttaacggattccattaccgctaccccgttagtcgtggtctcggtcagcatggtccgttccgcttcccgccagttgagcgagcggcaaacggccccgccgttgtcgtagtagataacttcgccttcgcgggccgggtcgtcttcttcagcccccaacgggaagaagccttcgccacccttagcaagtcccaagtggagatcgccttcgatcttatcaaggtcttcaatcccaaccggaaccccgtagctcagggaaacgctgttgtaaaggtcaaccaaagggatggttggttcaaaaacgtggccttggttcgcccgcttcaacagggcttcgatggatgcgcgggcacccttacgcttcttgaattgggagtacgcatcccgccactgcgcgatgaccgggttgtcacggaacgggtcggcggcggtgaacttagcggattccttgactgcttgggctaacagatcggcccgttgctggtgggtttcgggggtgtcgtggttatcaaaccccttgatcgtcatgatgttaatttgtgcttctggaaatagctcccaaaagcccggatcgatgattactttcttcataaaaacagacctcctaaaaagcttgaatgcatttatttatccattgtagccggtccaacgacatggttgcaagtttgtattatcagacgctttgtgaaataaagtctaaaagcgcttgcattgattaaatcctttttgcctgggcatttacattattaatttattatgaatgaaaacttaattttcaatcctgtgctaaatttcacctttgaaagtcacagcttttttgataaaatgagagccgtaaatgaaaagttatacggaattagcaaaggagatagactttatgaaggcagctgttattaatgatcccgtagatggatttgttacggtcaaagatgtccaacttcgcgacctcaagccgggtgaagccctcgttgacgttgaatactgtggcctttgccacactgacttgcacgtcgcagccggcgactttggagaaaagccaggcacgattatcggtcacgaaggggttggccgcgtaagcaaggttgctcctggtgttacctccctgaaggtgggcgaccgggtttcgatcgcttggttcttcaagggctgtggccactgtgaatactgcttaactggtcgggaaaccttctgtcgcgaagtcctcaacgccggttacaccgccgatggggccatggcacaacaatgtatcgttcctgctgattacgcagttaaggttccggaaggcctggacccagtcgaagctacttcgctgacttgtgccggggttactatgtacaaggccctcaaggttgctggcatcaagccaggccaatgggtatcaatcgttggtgccggtggtctcgggaacttggggatccaatttgctcacaacgtctttggtgctcacgtggttgccgttgacgggaacgaagacaagcttcaagctgccaagggaaacggtgctgaagtcttgatcaaccgtcatgatggtgacgttgacaagcaaatccaagaaaaggttggtggggttcacgctgccgttgttacggccgttaacgcttccgcctttgaccaagccgttgactccctgcgcccagacgggaagttggttgccgttgccttaccacaaggtgacatgcaattaaacatcgctaagacggtgctagacgggattatcgtggctggttccttggttgggactcgtcaagacctggctgaatgcttccaatttggggctgaaggaaaggttaagccgatcgttaagacgcggaagttggatgaaatcaacgacatgatccaagaattaaaggacaataaggtcgttggtcggaacgtggttgacttcgttcacgaataagcttgtttgctaacttaagttaaaaaaggtcgccctgcggggaggcccttttttatatctaaagagctttgtgggggtttctcaaccaaaagaatggtataattaaggtcaaaattagtcagggatgaggtgaacactcttggaagaaaaaagtatctcggacgtgattgaggattacttaaagcaaatcctcggtaactccgctcaaattgaaattcggcgcgcagaaattgccaaccacttcgatgtggttccctcacagattaattacgtgattaaaacccgcttcacccctaaaaatggctacctagttcgtagcaagcggggcggtggtggctacatccgcattgagcgggtcagcctacttgataacgtcgacgtgattgagatgatgatggatgtggtcggggcggccattaatgaacgtgacgcctttgccatcatccagactctgtacaaggagaagttgattagccgtcgggaaggggacctcatgctagcggccaccgctaagtcaaccttggctccccatggaacccggggggaggaaaacggcctacgggctcagatccttatgtcgctcttgaatcggttacgctatgaaagctaaccagaaagcgagctttaaatggataacgaaaatctatacacaccaagcgccaataacgtcttgcggattgcccaggaacaggcgcgcttttttaaacaccaagccgtcgggacggaacacctcctcttggccttgagcctcgaaaaggtgggggtggctgcgacggttttgcaccagtttaacgtcactagtgacgacctgcgtgaagagattgaacgctacaccgggtacggaaccatgcaaaacaccgctagcgatgcgtacctgcctaattcaccaaagttacgcgaaattttggccctggcggcccgcttggcccaacaaatgggggcaagacgtgtgggtactgagcacctattgttggccctgttgtcagatgagaccatcctttcctcgcggatccttttgaacttggacgtggaaccaaagcaagcccgccggatgttgttacggcgtttgggggtttctcaagagggacggcgcaaccgccggcaaaaccaatccaatacccaaccggaggagggggaagggactacgccaaccctcgataagtacggccgtgatttgacaaaggtggccagagaagaagggcttgaccccgtaattggacgggaaaaagaaatcaagcgggcgattcagatcctcgcccggcgggccaagaataacccggtcctgttaggggaaccgggggtcggaaagacggcgattgtcgagggccttgcccaacggatagttaacggtgaagttcctgatgaactagccgaaaagcgcttggtggtcctggatatggggaccttggttgccggtaccaaattcaggggtgaattcgaggggcggatcaaaaacgtcatcgatgaagtttaccgggacggcaaaattatcttatttatcgacgaaatccacaccatgattggtgccgggggagcagagggggcgattgacgcctccaacattctcaaaccggccctggcccggggggaactccagttgattggggcgactaccctggacgagtaccaaaagtacgttgaaaccgatgcggccttagaacggcgttttgcgacgatcatggttgaagagccaactaaggagcagacccgccaaatcctcgagggaattcggccccgctatgaaaaacaccaccacgccaagattactgatgaagcgctgatggcggcggttaacttgtcgagtcgttacattaccaaccgtttcttaccggataaggcgattgacctgatcgatgaggccggggcaatggtccgcatcgatggtgaagaaaaggggaaccaaaagaatggcttgacggtcaagttagaggaactccgggcacaaaaagaggacgcaattgccgagcaagactttgaccgggcggccgacttacgccacgaagagctaacggttaagcgacaaatcgaagaacagcgggaacgagacgcccagttggttgccgatggcaagttcctgtacaccgtgacggctgaagacattgccaaggtagttaacgaatggaccggggtgccgttaacccaactccaaaagaaggaaagcgatcgcttggttaacctggagagggtgcttcacaaacgagtgatcggccaagacgaagccgtttcggctattgcccgggcaattcgccgggcccgcagcggcttaaaggacccgaaccggccgattggttccttcatgttcttaggaccaaccggggttgggaagaccgagctggctaaggcgttagccgaagcgatgtttggccaagaagacaacatgatccggattgatatgtccgagtacatggaacgctattcgaccagccggttagtcggggcggcgccaggttacgtcggctacgacgaaggtggacagttgaccgaacaggttcgccaacacccgtactccgtcgtcttattagatgaggtggaaaaggcccacccagatgtctttaacctcctgttacaggtcttagatgatggggttttgaccgattccaagggacgtaaggttgacttccggaacacgattttgatcatgacctccaacttgggggcgacccagttggccgatgaaaagacggtcggcttcggggcgactggcgttcaaaataattaccaagcgatgtcggcggccatcaagcaacagatgcgctttcacttccggccggagttcttgaaccggattgatgagaccgtgatcttccactcgttgaccaaggaaaatattcaccaagtggttaagctcttgagcgcccagttggtaaagcgggtggcggaacaaaagatcagcctgaaactgaccccggctgccattgagttagtagcggcgaaggggtacaaccctgaatacggggcgcggccattacggcgggccttacaaacgatggtggaagacccgctctccttatcgatgattgatggccaagttgcggccggtgatcaagtgacgattggtgcccaacgggggaaattgagcttcaaagtcaaaacttctgacaacgcttcccggaacctagttctccaaaattaacaagttgattatgcaattaagccgctagctgacgggggaagggcgcccccgccgggcggcttttattgcgaaataaataaaagataagttaaactaattattgataattaagcggaacaatgtacaattagttattggtgaacacataatgataaggaactaagcagtttaagaagggaaaactaatgaagcgagcggaacaattagctaaaacccgaaaagcgatcttgcgaacggccaccaagttattcttggagaatggcttcaacggaacgtcaacccgggacattgccaaacacatcggaattactcaaccagccctttatcaccactttagtgataaagaggtcttgtacttagacgtcttgacggccttatgcggaaaggtacgccaagacatcaacaaggtgatgagaaaagaagacatggacccagaggagcgactctgggaaattgccaaggtcatcttgaagtaccacccgttgagtgtctacagccaatatcaatttgcccgccggtcgcttacggccagctcccaattgaagttggacatgatctttatgatggactacgtggaacccctgtcggaatacttcaagctgccagaggtcaacttacgtccagacctgttgccaaaagaagcggcagaactctttattgccagcttgacgccactgtttggaaccttccaacaggtcggtggtcgggccatcaacgaagaacaacggcaacgaatcatcttgagctgcattctgcacggctttgttaagcaagcatagccgttgacattcaaaccgaaagcttgtatgatacaagagtatgtaattgtgagttcagtgagcctcatgatctcttgtccatcaggctctttataaaaaaccaaaggcaccgatctggttgcttttggttttcttttgcccaaaaatggacttttggttaaattgtaaccgaaatgtaacattacgctcctggacccgtttatcaaactagagaggtgaatagtttggctggacacttagttaagtacggtaagcaccgtacccgtcgttcttactcccgaatcaaggaagtcttggacctgcctaacttgatcgagattcaaaccgattcttacaattggtttatggacaagggtttgcgggaaatgtttgacgacattatgccgatcgatgatttccaggggaagctatccttggaattcgttgactaccaattgttggaaccaaagtacacggtcgctgaagcgcgtgaacatgacgcaaactactcagcaccactgcacgtaacgttacgcctgaccaaccacgaaacgggcgaaatcaagtcccaagacgtcttctttggtgacttcccactgatgacggaccaagggaccttcatcatcaacggggccgaacgggttatcgtatcccaattagttcgttccccaggggtttactacaacgaagaagccgacaataatgggcgcccaagctacggtgccaacttcatcccgaaccggggggcttggctagaatacgaaaccgacgctaagggaatttcctacgtccgtatcgaccggacccgtaagctaccaattacggaattagttcgggcccttggttttggttccgatgacgaaatttgggacatgttggggagcgaatcagaatccctgaacgccaccattgaaaaggacctacacaaggaaccggaagactcccgggttgaagaatccttaaaggatatctacgaacggctccgtccaggtgaaccgaagacggccgactccgcacggtcccttttgacgacccgcttctttgatccaaagcgctacgacatggcgccagttggtcgttacaagactaacaagaagctgcaaatgaagtaccgtttgttaggtctgaccctggctgaaaccctggccgacccagaaaccggtgaaattatcgccaaggacggggacgtcatcactaaggaagtcttaaaggaactcgaaccggttctggaacaagacgactttaagatgatcacctacacgccatccgatgaagcagtggtaaccgcgccggttcaactgcaaaagatcatggtttactccaagaacgaccctgaacgcaaggtgccggtggtatctaacggtcacatctccttggacttaaagcacatccaaccagccgacatcctggcttcgatcaactacttcttgaacttacaagaagggatcgggactaccgatgacatcgaccacttgggtaaccggcggattcgttccgttggggaactgttgcaaaaccaattccggatcgggctcgcccggatggaacgggtggttcgcgaacggatgtcaatccaagacatcaacactgtaacgccacaacaactgatcaacattcgcccagtcgtggcttcaattaaggaattctttggttcctcccaactttcccagttcatggaccagaccaacccactgggtgaattgacccacaagcggcgtctgtccgccctgggaccgggtggtttgacgcgtgaccgggccggttatgaagtccgggacgttcactatacccactacggccggatgtgcccaatcgaaacgccggaaggaccgaacatcgggttgatcaactcgctgtcctcttacgcccgggtgaacgcatatggctttatcgaaacgccgtaccgtcgtgtctcatgggccgaccacaaggtaaccgaccggatcgactacctgacggccgacgaagaagataacttcatcatcgcccaggccaacacgccactgaacgaagatggttcctttgttcacgacgaaatcatgtgccgtgataaggaagactacatcgaaacggcgccagaaaacgtcgactacatggacgtttcgccaaagcaagtggtttccgttgcctccgcatgtattccgttcttggaaaacgacgactccaaccgggccttgatgggtgccaacatgcaacggcaagccgttccgttgattaacccacacgctccgttgatcgggaccgggattgaatacaaggccgcccacgactccggggtcgctttgatcgctaagaacagtgggaccgttgaatacgttgacgcccgcgaagtacgggtacgccaagaagacggaacgttagacacttacaagctgatgaagttccgccgctctaacggtggtaagaactacaaccaacggccaattgttaaggttggcgaatgggttgacgctgatgacgtcttagccgacggaccatcaatggaacaaggggaattagcccttggtcaaaacccactgatcgccttcatgacttggcaaggttacaacttcgaagatgccatcgccattaacgaacgcctagttaaagacgacgtttacacttcgatccacatcgaatcttacgaatccgaagcccgcgaaactaagctcggaccagaagaaatgacgcgcgaaattccaaacgtcagtgaagacgcccgcaaggaccttgatgaatccggggtgatccgggtaggggccgaagtccacgatggtgacattttggttggtaaggtaacgccaaagggggttaccgaactatccgccgaagaacggctcttacacgccatctttggtgaaaagtcacgcgaagtccgtgatacctccctcagggtgccacacggcggtggcgggatcatccaagacgtgaaggtctttacccgcgaaaacggtgacgaattagccccaggggttaacaagatggtccgtgtttacatcgcccagaagcggaagatccaagtcggggacaagatgtccggtcgtcacgggaacaaggggacggtttcgatcgtcgttccagaagaagacatgccgtacatgccagatgggaccccaattgacattatgctgtcaccaatgggtgtgccgtcccgtatgaacatcggtcaggtgatcgaacttcacttggggatggctgctcgcgagctggggatccacattgccacgccagtctttgatggtgccaacgaccaagacgtttgggatgccgttaaggaagccggcttaccgtccgatgggaagacgatcctttacgatggtcggaccggggaaccatttgaacaacgggttaccgttggggtcatgcactacctgaagctggcccacatggttgacgacaagatccacgcccgttcgactggtccatactcactggttacccaacaaccacttggggggaaggcccaattcgggggacagcggttcggtgaaatggaagtttgggccctggaagcatacggggctgcttacaccctgcaagaaatcttgacttacaagtctgacgatacggtcggccgggtaaatacttaccaagccatcattgacggggaccaaattccaaagccaggggtaccggaatccttccgtgtgctggttaaggaattgcaatcccttgggttagacatgaaggtcttagatgacaagcacgaagaaatccagcttaagagcatggatgaagacgttgctgacgttcggaaactggcccgccgtggccacgaaacgctggaagaacaaccagcgcaagcgacgagcgcccaagacgaagccaagcaagattaggttcgccacttagggattaaataaggaggattatcctttgattgacgtcaataattttgaaagtatggagatcggtctggcttccccaatgaagatccggagttggtcttacggtgaggttaccaagccggaaacgatcaactaccgaactttaaagccagaaaaagacggtctctttgatgaacgaatcttcggcccgaccaaggactttgaatgtgcctgtggtcgctacaagcgggcgcgttacaacaagcgggtctgtgagcgttgtggggttgaagtaacctctgccaaggtccgccgggaacggatgggtcacattgaactggctgctcctgcttctcacatctggtacttcaaggggattccgagccggatggggctggtcttggacatgagcccacgggaactggaagaagtaatctactttgcttcttacgtcgttttagacgccggggacacgggactggaaaagaagcaattgctttccgaaccacgttaccgggaactcaaggaagaatatggcaaccgtttcaccgctgagatgggggccgaggcgatccaaaagctactggccgacgtagacctggccaaggaagcaaccgaattaaaggcggtcttaaaggaagcaactgggcaaaagcggacccgcgcggttcggcgcctggatatcttggaagcctttctcaagtccgggaacaagcctgaatggatggtgatggacgtaattccggttatgccacctgacttacggccgatggttcaactggaaggtggccgctttgccacttccgacttgaacgacttgtaccggcgggtcattaaccggaacaaccggttgaagcgcctgttagaattaaacgctccgggcatcatcgttcaaaacgaaaagcggatgctccaagaagccgttgacgccctgattgataacggtcgccgtggccgtccggttgccggtcctggtaaccgtccgctcaagtccttgtcccacttacttaaggggaagcaaggacggttccgtcaaaacctgctcgggaagcgggtcgactactctggtcgttccgttatcgatgttggtccatccatgaagatgaaccaaatggggttgccggttccaatggcgatggaactcttcaagccatttatcattcacgaactgaccaagcggaacctggctaccaacgttaaggcagccaagcggatgatcgacaagcgtgacgaaaaggtcttcgatgtcttagaagacgtgatcaaggaacaccctgttctcttgaaccgcgcccctaccctgcaccggttagggatccaagccttcgaaccaatcctggtttccgggaaggccatgcgtttgcacccactggtttgtgccgcttacaacgccgacttcgacggggaccagatggccatccacgtaccactgtccgatgaagcccaggccgaagcgcgtctgttaatgttagccgctcaccacatcctttcacctcgtgacggggaaccaatcgtggccccatcccaggatatggttatcggtaactactacatgacgactgaagacaaggcccgtgaaggggaaggtatgatctttaaggacaccaacgaagcccggatggcctaccgtaacggttacgtggccttacaaacccgggttggggtgctgacttcttcctttgacaagaagccgttcaccgctgaacaacgccaaaagatcatggtgacctcggttgggaagttgctcttcaacaacatcatgcctgaagattacacttacattaacgaaccgaccgccgacaacctgcaaaacggggttccggacaagtacttcttggaacctggtgaagacattcacgcctacttagaaaacgcgccgctggtgccgccgtttaagaagggcttcttgtcggacatcattgccgatgtttacaagatctacaaggtgaccgtcacctcccaacttcttgaccggatcaaggaccttggttactacgaatccacgatttccgggttaaccgtcgggatcgccgacgtgaccgacttaaaggaaaagccggaaatcatcgaaaaggcgcacaagcaagtggccctggttacgaagcaattccgccgtggtttgatcaccgataacgaacgttacgaacgggtcattgggatctggaacgatgccaaggatgaagttcaaaacaagctgatcgaacacatggatatccacaacccaatcaacatgatgtccgactctggggcccgggggaacatctccaactttacccagctggccggaatgcgtgggttgatggcttccccatccgggaagatcatggaactgccgatcctttctaacttccgggaaggcctttccgtcttggaaatgtttatctcttcccacggggcacggaaggggatgaccgacacggccttgaagactgccaactctggttacttgacccggcggctggttgacgtggcccaagatgtgatcgttcgcgaaaaggactgtggcaccgaccgtggtctggaagtgaccgccatcactaacgggaacgaaatgatcgaaccgttatacgaccggattttgggtcgttacacgatgaagtccgtctttaatccggaaaccggggaaaagatcgtcggtaaaaacgtcctcttgaacgaagagatggcgcaaaagattatcgatgcgggcgttcaaaaggtgacgattcgctccgccttcacttgcaacaccgaacacggggtttgtgaacgttgttacggacgcaacgccgctaccggggaccaagtggaagccggggaagcaatcgggacggtggccgcacagtcaatcggtgaaccagggacccagctgacgctgcggaacttccacaccggtggggtggccggtaacgacgacatcacccaagggcttccgcgtatccaagaaattgtggaatcacggaacccgaaagggaaggccacgatttccgaagttactggtcaggtggtttccatcgaagaaaacccagctgaacaaactaaggacgttacgatcaagggtgaaaccgacacgcggacttacaccctgccgatcacggcccggatgcgggtggccgaaggtgatgatattcaccgtggtcgtgccatcaacgaagggtcaattgatccaaaggaaatgattcgggttcgcgacgtcttgtccacggaaacctacctgctctccgaagtgcaaaatgtttaccgtatgcaggggattgacctgctcgacaagcacgttgaaatcatgattcgccaaatgatgcgtaaggtgcgggtgatggatcctggtgatactgatgttttaccgggtgaactgttggacatcagccaattccgcgatgctaactaccaaaccttgatttccgggggaattccggccactgcccggccagttatcctcgggatcactaaggcggcccttgaaactaacagtttcctttcggccgcttccttccaagaaacgacgcgtgtccttaccgacgccgccatccggggcaagaacgacccgctggtggggctcaaggaaaacgttattatcgggaagatcattccagccggaacggggatgggtgcttaccgcaacatcaagcccaaggaagtcagtgtcaacactggcgcaaccgatggggccattacctccatccgcgaaatggaagaacaactaaaggatcaagactaagcgcttgattgaataaaaaggacccgtcaaaccaagctggtttggcgggtcctttttgatgttgaatttagatttgttggctagcgcggtcaatcaggtccttgaaaatgacttgtgattccggtgtgtgtttaaacatgttttcggggtgccactgaacggcgagaatttgattagaatcgatggattcgaccgcttcgattaccccgtcgtcagcgcgggcaacgactttgagtcccggcgccacctcatgaattgactggtggtggcgggagttgatgtagattcgattaccaaccagtttttgaagctgggagccctcgtggacattaacgtggtgggtggggaggtttcctggggctaactggtggtgcttaagacgggcggtcgggtcttcagaaagatcttgataaagggtgccgccgagcccagcgttaatcaattgcaacccccggcagattcccatgatcggtttgccggcctcaatggtcgccttaagcagggcgatttcaaagaggtcccgtttacggaaggtttcccctaattcaaagtggggctcctgaccgtaaaaggtggggtcaacgtcaaaaccgccgagcaacaagagcccgtcgaacaggtcaacgtaagaggcggcgttttcggcggccacggttggcaagacgatcggaagccctcccgacttggtgatcgctttaatggccggatcgggcgcaaaagcggcgtttcgtaagttgatgatgctagttgcctcggtataggtatcggctggtaaagcaatcattggttttctcatcgtgagtccccccgtagtttaagtgtattgccctagtctaggggagggagtggcgcatgtcaaactttataattaaattttagtgagagtgtggtagtggtctaaattgatgataatctagtaagtataaaatcagttaacaaggagaagtggattgaagaattatcgcgtggaagttcccaaggtcgcccgggaccagttagaaattaaagatggcgagcccttagcaatgtgggtggaaggcaaccagttggtgattcgcccactgcggttggctgacagtttaccccaaatcaagctccggtggtactttggccccgccttagtactgacgttgttgttttacgccgatatgattaaccaaggctaccacctcttgccactggtggggggtgattcggtggcgtcggctagcctttaccttgctactttaagcgggttattggcctttgccagcaccttcattagccaaaaacgtcaccatcgtggccgggcgcaggaattttcttggcgggctatgatcagcattatggttgcttgcgggacgattaccgccttttcgttggtggcgggagcctggttggtggggtcgctttttcacggggccgtttttgacatttacacggccggcgccctgatttttttggtgattgccatggttacttacatcatgatcaacctggccatgacgatttctcccggggtgattactaacctaatgacattcatgattattgggggggtgttcttctcgatgttaactaattccaataaggattggtggcgtcataattttagcttcctggggacggcaaactcgtcgaatagctggcagtttaatattaccctgatcttttcggcaatgctgatgttgaccttgattgactatttgtttgtcaacctgtccaagaagtaccccggctggcgggttcaagtgacccgctggctacttaacttaatggcagcttgcctaggtggggtcgggctgtttccaaatgacccacgttttcaccttcttcacgatcgcatcgccatgtggatggtttacaccatgttaattttggtggtagtggttcggtggacgatgccaatgatgactaagaccttcttgaccctttcttacgtgatcggtggcgtgttggccgttagttacatcgcttttaagttcgtccgctacctttctttaaccgcttttgaaatgctggcctttgggatcgcgttttcgtggattttgttacttttccagttaattgaagccgtcgtgcaaagggacgtccgcctctttaccgtcgaattggtggccgaagaaaatgacgaggttagtcattaattataactagggggctgaggaaacgtgtttttccagtccccttttgaattcccggagaatttataaaaacatacccaaagaaaacaaaagacccggaggttaagtacggctaaagaacgccacggaccaactaccctaccgctaaatttagtcattcccgttggaaacttaatttccactcgttttctagatcaacaatgaaacgagcagcccggtagaaaggtagggcaaaaaggggagtggttggcggtgccataacttaggggaggttaaggctaggccgcagccaattagcagggtttgccaatagcactgccacccagctaaaagtaagacgactaagagccattcaagatcacctaggcccagtccgtggctaagtaaggtgatcaatgagagtaatcccgccactaataagaagagggcgggttgttctatccccaggggagacaacgcaattaaggggagggggagtaggctagtcagggcgagggggttcatccacccggcgtaccagtcggtagtggccatggctgacaggccagttaacaggactaggcttgctaaccactcggttaagtcaaggggggtgtatagggctaaccacgttccgcaagttagttcgcacacactggaccagggggcgatggattttttgcaccaccggcaccgccccaactgaagggcgaagccgacgaggggaatcaattgccaccaggctagggggtgggcgcagtgatcacaaagcgaacggggggaagaaggtcccatttctagaaggtgccgctgggtcatggtgacgatgaacgatgctaggcaagagccggttaaaaaggcgattagttgttccataattagttcctcctgcccattaagtacggcaaaaccactcaatgttacgaatttgatcatagttgtcgttgactttagtcggagagcgtgttaatttaataaaggtgcttttttgagcaacggattggtctgtcgttgggcagacggcatgcgcagcgatagcacaaaactaaataacatccagcgccctttttttattccaaaaaaagaaccgcctggatgtgtggacttaaattaaggaaggggaaaaattatgcctaccattaaccaattggttcgtaagggccgcaagagccacaagggtaagtcaaagtcacctgccctgggctttgtatacaacagttttaagaaggaagaaatcaagaacccatcaccgcaaaagcgtggggttgctacccgtgttgggacgatgacgccaaagaagcctaactccgccctgcggaagtacgctcgtgtgcgtttatctaacctgatcgaagtgacggcttacattccagggattggccacaaccttcaggaacactccgttgtcctgatccgtgggggccgtgttaaggaccttcctggggttcgttaccacatcatccgtgggacgcttgataccgccggtgttgacggccggatgcaaagccgttccaagtacggtgctaagaagccgaagaagtaatctttatataggagggattaagcaatgccacgtaagggacatgtagcaaagccggaagttttaccggatccaatttacaactcaaagctggttaccagcctgattaaccacttgatgcttgatggtaagcgcgggaccgcttctaagatcctctaccaagcccttgaccaaatcaaggaacaaactggtaacgacccgatcgaagtgttcgaacaagcaatggaaaacatcaagccggcccttgaagttaaggcgcgccggattggtggttctaactaccaagtgccgatcgaagttcgcccagaccgtcaacggacgttggcacttcgttggctcgtgcaatacgcacgtcttcgtggggaacacacgatggtggaacgtctttctggcgaaatcatcgatgcttccaacaacactggtgcttccatcaagaagaaggaagacaccctgcggatggccgaagctaaccgggccttcgcacactaccgctggtaagattgcggtttgaaactagcccttaaactagttacaatcaggaggggtgacggcggaaactccactcgtcacccctttttctaaaaataacaacacaaacacggaaggagatcacttttaagatggctaacaagcgtgaataccctcttgaaaagacccgtaacattgggatcatggcccacatcgatgccgggaagacgaccgccactgaacggattttgtactacaccggtaagattcacaagattggtgaaacccacgatggggcttcccaaatggactggatggaagaagaaaaggaacgtgggatcacgatcacttctgccgctactacggccgtttggaaggatacccggatcaacatcatcgacaccccaggacacgtggacttcactgtcgaagttgaacgtgccctccgggtgctcgacggtgccgtaaccgttcttgacgcccaagccggtgttgaaccacaaactgaaaccgtttggcgtcaagccgacgacttcaacgttccgcggctggtcttcgctaacaagatggacaagatgggggccaacttcgactattccgttaagaccatcaaggaacgcctgaacgttacgccgcttccaatccaaatgccaattggtgccgaagacgaattcgccggtgtgatcgacctggttaagatggttgcttacatctacgacgaagacaagctcggcgaaaactgggacaccgttgaaatcccagccgacatgaaggatgaagccgaaagccgtcacgacgcaatgatcgaaacgctggctgacgtaaacgacgacatcatggaaaagtaccttgaaggtgccgaaatctccgttgatgaaatcaaggctgccatccgtcaagcaaccctggaccaagaactcttcccggtaatggcaggttctgcctacaaggataaggggatccaaatgatgcttgatgccgtcttggattacctgccatccccagttgatgttaagccattcgttgctcacgacgaggaaggtaacgccattgaactgactgccggcgatgacaagccattcgccgctttggccttcaagatcgcaactgacccattcgttggtcgtctgactttcctgcgggtttacactggttcccttaaatctggttcttacgttctgaacgcaaccaagggcaagcgtgaacggattggtcgtctgcttcaaatgcactccaaccaacaaaacgaaatctcagaagtcttctctggtgatatcgccgctgccatcggtctgaagaacaccaccactggtgactccttgaccgacccagaccacccactgcaacttgaatccatggacttcccagaaccagttatccaggtttctgttgaaccgaagtccaaggctgaccaagacaagatggacaagggtctgcaaaagttggctgaagaagacccaactttcaaggctgaaacgaaccctgaaactggtgaaactctgatcgccgggatgggtgaactgcacttggacatcatcgttgaacgtcttcgccgtgaattcaacgccgaagttacggttggtaagccacaagtttcctaccgtgaagccttcactaagcaagtttccgcccaagggaagtttgttcgtcaatctggtggtaagggtcaatacggggacgtatggatcgaatttacgccgctggaagaaggggccggcttcgaattcgaagacgccattgtcggtggggttgttccgcgtgaatacatcccagccgttgaacaagggttgaaggaagcgatggaaaacggtgttctggccggttacccattggtcgaccttcacgctaagctttacgacggttcctaccacgaagtcgactcctctgaagctgccttcaaggttgccgcttccttagcattacgtaacgccgctcctaagggtggagccgttatccttgaaccaatcatgaaggttgacatcgtcgccccagaagataacctgggtgacgtgatgggtcacgttaccgctcgtcgtggttcgatcgacgggatggaagaacgtgggaacgcccaattagttcactccttcgttccgctgtccgaaatgttcggttacgcaacgacccttcgttccgcaacccaaggacgtggtaccttcacgatgaccttcgaccactactcagctgtgccgaagtccatccaagaagaaatcatcgaaaagaacggtggtaagtaattaacttgacccgtaaaaaaacaggtgctagcagctgctggcacctgttttttgtatggaatgctagggagtgtttcgatcaaggaaggggagaagagcgccgtcgaaaaaaattaagcgtcttttttcatggtcgaaggacaaagaaaaacgacgaaaccactttcttgaaattaatcccagaaaatccttgctacaccaggctttttcttgtattatagaaaaagtgcttgaacaaaagaggagcagagagtggccctcgctaggatttcagcacgcaggcgatgaagtggaaggttgcgacacacccggccgctttgccacaggatgtggcggtaatttccatggagctagtcataatttcaaatttgacgaaggagggaacacaatggcaaaccaaaagattcgtattcgtttaaaggcttacgaacaccgcgttttggatgaatcagcagacaagattgttgaaagtgcaaagcggaccggtgctcaagtatcaggcccgattccgttacctactgaacggactctttacacggtgattcgttcaccgcacaagttcaagaagtcacgggaacaattcgaaatgcgcactcacaagcgtctgatcgacatcatcgacccaacccctaagacggttgacgccctgatgaagctcgatctgccaagtggtgttgacatcgaaatcaagctttaattcaaaatctaaaaacaaacaaaaatcaaattaaattggaggtgtactcatgaccaaaggaatcttaggtaagaaggtcgggatgactcaagtcttcactgacaacggtgaattggttccagttactgttattgacgtaacgccaaacgttgttatgcaagttaagacccttgaaaatgacggttacagtgccgttcaactcgggttcgacgacaagcgcgaagttctgagcaacaagcccgaacaaggtcatgcagcaaaggctaacacgactcctaagcgcttcatcggtgaaatccgcgacgctgaattaggagacgacatcaaagttggggataaggtagcagccgacattttcgcagaaggcgaaacggtcgacgttactggtaccaccaagggtcatggttaccaaggtaacatccataaggacggccaacggcgtgggccaatggcgcacggttctcgttaccaccgtcgcccaggttcacttggtgccatcatcaaccacgtgttcaagggtaagaagctgccaggtcggatgggtaacaacacccggactgtgcaacacctgcggatcgttaaggtcgacactgaaaacaacgttctcttaatcaagggtaacgttcctggtgccaacaagtcctttgttacgatcaagaactccgttaaggctaacactaagaagagccttagcaagcaatccaacaagtaagaaaggaggaagtaatcaatgactagtgttgcattattcaagcaagacggtagccaaaacggcactgttgaactgaacgacagcgtattttctgttgaagcaaacgaatccgctgaattcgatgcgattcttcgccaacgtgcttccctgcgtcaagggactcacgcggttaagaaccgttccgcagttcgcggtggtgggaagaagccttggcgtcaaaagggtactggtcgtgcccgtcaaggttccatccgcgcacctcaattccgtggcggtgggatcgtctttggcccaacccctcgttcctacaactacgcattaccacgtaaggttcgtcaattagccatcaagtcagccctttcccaaaaggttgccaacgacaagttcgttgttgttgatggtttgaactttgacgcaccaaagacgaaggaattcgctggcgtaatgaacaacctcaaggttagcgaaagggtcttagttgtggttactgacgaagacaagaacgctcaattatcagcacgcaacctgccgaagacgacggttgtgacgccagctggtgtgaacatcttgaacgtcgttgacgcccaaaagatcatcattacccagtcagctctttctcaagtagaggaggtgctcgcataatggaagcacgcgatatcattttacgtcctgtaattacggaagcctccacggctgccatggacaacaagcgttacacgttcgacgttgatttacgagcaactaagacgcaagtcaagaacgccgttgaagaaatcttcgacgttaaggttgtgaaggttaacatcatgaacgttaagggaaagcaaaagcgccaaggccgttacgtcggctacacgaagcgccgtcgtaaggcgatcgttcagctttctgctgactccaacgaaatcaagttattcggcgacgataacgaataaatctaacggataggaggaaaacacagtgggaattcgcaaatacaaaggcaccactaacggacgccgtaacatgaacggttacgacttcgcggaaatcacgaagacgacgccggaaaagtcgttattggctccgctcaagcacaccgctggtcgtaacaacgctggtaagatgaccgttcgtcaccgtggtggtggtacgaagcgtcaataccggattatcgacttcaagcggatcaaggatgatgttccagcaactgttaaggccattgaatatgacccgaaccgaactgctaacatcgcattgcttggttacgctgacgggactaagtcttacatccttgcaccgaagggtctcaaggttgggatgactgttcaatctggtccggatgcagatatcaaggttggtaacacgttaccgctgaagaacattccagttggtactgttattcacaacatcgaacttaagccgggtaagggtggtcaattgacccgttctgccggtacttctgctcaacttcttggtaaggaagaaaagtacgttctggtacgtctttcttctggtgaagttcggatgatcctggctgcttgccgggcaacgattgggtcgatcggtaacgatgaacacggtctgctcgttaagggtaaggctggtcgttctcgttacgctggtcaacgtcctcacgttcgtggttctgttatgaaccctaacgatcacccacatggtggtggtgaaggtaaggctccagttggtttaccatctccactctccccatggggtaagaagactgttggtaagaagactcgttcacacaaggctcgttccaacaagttcattgttcgtgggcgtaagcgtggtccacacacgcgttaatcactcataaatcgtcaaatacccgagaggaggtacaaaaatgggtcgtagtttaaagaagggaccttttgcagatgcttctttattaaagaaggttgaagctcaagcagatagcgacaagaagaccgtcattaagacctggtcacgtcggtccacgatcttcccgagctttatcggatacacgttcgcagtatatgatggtcggaagcacgtgccagtttacgtacaagaagacatggtaggtcacaagcttggtgaattcgtaccaacgcggactttccgtggtcacgctgccgatgacaagaagactggtcgtaagtaaaggagggaattgattaatggctgaaaacgttacttcagctaaggcaactgctaagatggtccgtgtatcatctcgcaaggtacgcctggtgcttgacaccatccgtaacaagtccgttgccgaagcatttgctattctgaagttcactccaaacggggctgcttcagacgtcgaaaaagttttgaaatctgctgttgcaaacgctgaaaacaactttgacctggaccaagcatccttggttgtaagcgaagcctttgctaacgaaggaccaaccttaaagcggttccgtccacgcgccaagggttctgcttctccaattaacaagcggaccagtcacatcacagtggttgttgcagaaaagtaggaggaatgaatagtgggtcaaaagattaatcctaatggtttccgtgttggggtcattcgcgactggactgctaagtggtacgcagataagaactacgccgcttacctgaacgaagaccttcggatccgtaaatacatcgaaaagcgacttgctgacgcctctgtatcaaccgtggaaattgaacgtgctgctaaccgcgtaaacgtatcaattcacactgccaagccagggatggttattggtaagggtggttcagaagttgaagcacttcgcaaggaacttaacaacctgaccaacaagcgggttcacatcaacgtggttgaaattaagaagccagaccttgatgcacacctggttggtgaaagtgttgctgaacaacttgaaaaccggattgcattccgtcgtgcgatgcgtggtgctatgcaacgtactatgcgtgccggtgccaaggggatcaagattcaagttgccggccgtttgaacggtgccgacatgtctcggatcgaatcctactctgatgggactgttcctttgcacacgcttcgcgcagatatcgactactcctgggacgaagctcacactacctacggggttctggggatcaagacctggatctaccgtggtgaagttctcccagctaagaagaacaacgaagctaagggagggaactaaaacatgctagtaccaaagcgagtaaagcaccgtaaggttcaacgcggtaagatgcgtggggaagccaagggtggtaagaccgttacttttggtgaattcggtctgcaagctctcgattctcactggatttctaaccggcagatcgaagccgctcgtattgccatgacgcgttacatgaagcgtggtggtaaggtttggatcaagatcttcccacacctttcttacactagtaagggtgttggtacccggatgggtaacggtaagggtgctcctgaaggttgggtagcccctgttaagcgtatgaaggtgatgttcgaagttgctggggttcctgaagaagttgcccgtgaagcccttcgtcttgccggaaacaagttgccagttcgcactaagatcgttaagcgtgaggaagtaggtggacaatctaatgaagactaaagattacgtacaagaactgaatggattaaccactgagcaattgctgaaccgtgagaaggaattgaaggaacaattgtttaacttacgtttccaattagcaaccggccagttggaaaacactgcaagccttaagactgttcgcaagaacatcgcacgggttaagacggttcttcgccaacaagaattaaacaactagaatacgaaaaggaggattacgcatgagtgacgaacgtaatgcacgtaaggtgtaccaaggtcgcgttgtttctgacaagatggacaagacgatcacggtcgtaattgacacctacaagagcgcgccgatctacggcaagcgggttaagtactccaagaagtactacgctcacgacgctaacaacgaagcccacgttggtgatactgttcaaatcatggaaacgcggccgctgtctgctaagaagcgtttccggcttgttaaggtcgtagaaaaggccgttaccttataatcaacaaaccttaaattcgtattctaattcttacttatagacggaaggaggacactaaccgtgattcaacaagaaagtcggttgaaggtcgcagataactccggtgcccgcgaaatcctggtcatcaagattttgggtggttcccgtgttaagaccggtaatattggtgacattattgttgctactgtaaaacaagcaacaccaggtggcgttgtcaaaaagggtgacgttgtgaaggccgttgtcgtacggactaagcatggtctgcaccgtaaggatggttcctacatcaagtttgatgaaaacgcagccgttttgatcaacaacgacaagagcccaaagggtacccgtatttttggcccaatcgctcgtgagttacgtgacgatgactacatgaagatcatctcactggccccagaagttctgtaaagattacccaaaaataaggaggtgcactaccacatgtttttaaagacaggtgacaaagttcgcgtcatcaccggtaaggacaagggtcaagaaggtacgatcaagaagaccttcgccaaggaaaaccgggtgatcgttgaaggtgttaacaagatcaagaaacaccaaaagccaagtaacatgaaccctaacggcgggatcatcgacactgaagcaccgattaacgcttcaaacgtgatgctgcttgacccatcaacgaacgaaccaactcgggttggctttgaagtcgttgacggcaagaaggttcgggttgccaagaagtctggcaagcaaatcgactaatcattagcgaaaggaggaacaatcttcttatggaaaaccgtttaaaagctaagtacgaaaacgaagttcgcccatctttgattgaaaagtttgattactcttcagttatggctgctcccaagctcgaaaagatcgtcttgaacatgggggttggggacgcaacgcaaaactccaagaaccttgacgaagccgttgaagaacttgggcttatctccggtcaaaagccactgatcactaaggccaagaagtccatcgccggcttccgtcttcgtgaagggatggctatcggtgccaaggttactctgcggggcacgcggatgtacgacttcttggacaagttagttaacgtttccttgccacgggttcgtgacttccgtggggtttccaacaaggcctttgatggtcgtggtaactacacgttgggtgttcgggaacaactgatcttcccagaaatcgattacgataacgttaaccgtgttcgtggtttggacatcgtcatcgttacgactgctaacagcgacgaagaagctcacgaattactggcccaattagggatgccatttgctaagtaattaggaggttacaaaattggctaaaaaatcaatgatcgctaagagcgaacgtccggccaagttctcaacgcaagaatacacgcgttgcgaacgttgtggccgcccacactccgtttaccgtaagttccacctctgccggatttgcttacgtgaccttgcccacaagggacagattcctggtatgaagaaggctagttggtaaacaaatcaccgacaaaaggaggaaaaacatcgatgtctatgagtgatccaatcgcagatttcttaactcggatccgcaatgccaacatggcacaccacgattcagttgaagcacctgcatccaagatgaagaaggacatcgccgaaatcttgaagcaagaaggtttcatccgcgatgttgaatacgttgaagacaacaagcaaggcatcatccgcgtattcttgaagtacggccaagacggcgaacgcgttatttccggtttaaagcggatttccaagccgggtcttcgctcctacgttaaggcagacgctgtgccgaaggtcttaaacggcttagggattgccatcatttctacgtccaacggcgtggttactgataaggttgcccgtgctaagaaggtcggcggcgaagtcgttgcctacatttggtaataaataaactaacaaaggaggtgtacgcatgagtcgtattggttacaaggaaattgatttgccagcaggcgttgaagtttctcaagaaggtaacgtggttactgttaagggaccaaaggggaccctttctcgtgaaatttctccgctgatcacgatgtccgttgaaggcaacgtggttaagttcgaacgttctggcgaagataacaaggtccgtgccctgcacgggactacccgcgccaacgttaacaacatggttgaaggggtcgttaatggattcaagaagaccttgaagctcgtcggggttgggtaccgtgcccaattcaagggtgacaagttgatcttgactgttggttactctaacccagttgaaatgacgaagcctgctgaagtggaagttgctgttccagacaacaccacgattgaaatcagtgggattgacaagcaagaagttggtgacttcgctgctgaagttcgtgccgttcgttcacctgaaccatacaagggtaagggtattcgttacgaaaacgaacacatcgtccgcaaggaaggtaagactggtaagtaatcataggttacaaccagcaagttaaactaatctaaaaataagaggtgacagttgtgatttctaaaccagacaagaacaagatccgtcaacgccgtcacatgcgcgttcgcggtaagatctctggtactgcagagcgcccacgtttaagtgtttaccgttctaacaaaaacatttacgctcaattaattgatgacgtaaagggtgtgacgctcgcaagtgcctcaacccaagatactgaagtaagtggtaagactaagaccgaacaagctgccggtgttggtgccctgatcgctaagcgtggggttgaaaagaacgttaccactgttgtgtttgaccgtgggggttacctttaccatggtcgggtacaagctttagcagaagccgctcgtgaaaacgggcttcaattctaaggaaagggaggaattacccgtaatggcatcatcatcatacattgatccagctaagttggatcttgacgatcaagttgtttccatcaaccggattaccaaggttgttaagggtggtcgtcgtctccgctttgcagccctcgtggttgtcggtgaccacaatggccacgtcggcttcggtactgggaaggcccaagaagttccggaagcaatccgcaaggcttctgcagccgctcaaaagaatctgatcaaggttccaaccgttggaacgaccattccgcacgaagttatcggtacttacggcggtgggaagatcatgttaaagccagccgttgaaggttccggggttaccgccggtggggccgttcgtaacgtgatggaacttgcaggggttaacgacgttacctcaaagcggttaggttccaacacgccgatcaacgttgttcgtgctacttttgaaggtctcaaggccttgaagagtgccgaagaagtttccaagctgcgcggcacatccgttgaccacctggcagaataggaggacaccaaacatggctaaagttaaagttactttaatccgcagtgttgcccaccgtcagccgactcaacgccggaccgttaaggctctggggctgggcaagcttcacagctccgttatcctcccagataacgcggctactcgtggtgcaatctttaaggttgcgcacttagtttccatcgaggaagttaagtaaaaaacaaaatcaaataaggaggtgccaactaatgcaattaaacgaattaaagcctgttgctggctcacgtttcaagcggcttcgtaagggtcgtggcctttcttccggtcacggtttcacttctggtcgtgggacgaagggtcaaaaggcgcacggtaagacccgtcttgggtttgaagggggccaaatgcctctctaccggcaaaagccaaagcgtggtttcaccagcatgaaccacaaagacttcgcccttgtttccctgacgacgcttaaccaattcgaagacggcgctgaagttacgccagaagttctggttgcaaacggcgtgatcaagaacgttaagagtggcgttaaggttttggcaactgggaagcttgaaaagaagctgaccgttaaggctaacaagttctctgcttcagccgttaaggcaattgaagctgccggtggtacgactgaggtgatctaaatgttcacaaccgtcaaaaacgcgttccgggtcaaagaaattcgacaccggatcttctttaccctgttcgtgttgattgtttaccggttgggagcttcgatcaccgttccgggagttaacgctgcggccttgcagcaactctcgtcatcgggattagcatctattcttaatacctttagtggtgggggtttggaaaactactccctctttgcgatgggggtttcgccgtacattacggcccaaattgtcgttcaactgctacaaatggacatcgtgccgaagttcgttgaatggtcaaaacagggtgaagttggacggcggaaattaaaccaggcgactaggtggttaacgattatgttgggctttgtccagtcgatcgggatcaccgccgggttcaacgccctctccaccattaaactggtgaataatccggggatgaagacctacctcacgattggtctcatcctgacggctggaacaatgtttgcgacctggatgggggacatgattaccgagcggggacttgggaacggggtttccatgttgatctttgccgggatcatcgcccagatgccaagcgcaatccagcagttgtggacggatcaaatcactggcgaatccgggagtgccctttggatgggcatcgggttcattgcgctggttgtggtggctttgctgatcatcgttgcctttgtaacgtgggttcagcaagctgaacggcgtttgccgattcagtacacccggcggacgaccgtctcgccggccaatagctacctgccattaaagattaacgtttccggggtgatcccggttatctttgccggttcggttatttcgacgccgcaaacgatcttaatggcctttcagcaaaatcattccggggatacttggtaccaagttatgaccagtatctttaaccttcaatcgggtcccgggataaccctgtacatcttcttgatcgttgtgtttaccttcttctacgccttcgttcaggttaacccggaaaaattagccgaaaacttgcaaaagcaaggctcctacatttcgggggtttggccggggaaggggacccaagactttgtctcggggctcctgatgcggctatcgaccgttggggcccttttcttgggcctgatttctctgattccattgattgcttccaacgtttggaacttaagccaatcaatcgggcttgggggaacgagtttactgatcgtcgtccaaatcgccttggacgtcgtccggcaactaaacgggttgacgatgaagcgtgaatacattgggtttatccatgaatagtagccataaggaggcacaacaatgagcacaatgaaccttgtgttaatggggctgccgggtgccggtaagggaacccaggcccaattaatcgttaaggactttgatatcccgcacatttcaaccggggatatcttccgggctgccatcaagaaccaaacgccgatgggtgttgaagcaaagaagttcatcgataagggtgaactggttcctgatgaggttaccaacgggatcgttcaagagcgcctagcgcaagacgataccaaggatggatttatgttggacgggttcccccggaacctcgcccaagctgatgcactaaacgcaatgcttgtggacagtgatcgccaactggacgccgtgatcaacattcacgttcgtccggaagttttagttgaacgacttagtggtcggtttatctgccggaactgtgggacaacataccaccgtctctacaacccgacgaaggttgaaggcacttgcgatgtctgcgggggccacgacttctaccagcgggacgacgataagccggaaactgtcaagaaccggttagacgtcaacattaaactgaatacgccactgattgacttctacaagaagcaaggtgtgttatacaccatcgatggcgaacaagatatcgataaggtttaccaagccgttaaggaagttctgacgaacctgtaagcgaggtttaccttgcgcattcacccttaccgtggtagaatacacaaggtttatctagttttcgtgggagacggttgtcttccaccctttttacgtaagtaatagtaatattaaatcgagacggcgaggaggaaccattcagtggcaaaggccgatgttatcgaagtcgagggtaaggttactgaaaccttaccgagcgcaatgtttaaagttgaattggaaaatggggttgaaattctggcccacgtttccggtaagattcggatgcactacatcaagattttacctggggaccgggttcgggtggaaatgtctccatatgatctgaccaagggccggattactttccgcttcaaataagacttagtctaaagatcttttaggaggattatttacaatgaaagtacgaccatcagtaaaacggatgtgcgatagctgcaagattgttaagcgtcgcggccgggttatggttatctgcattaacccaaagcacaagcaacgccaaggcaagtaatttagaataggacggaggtgtcaaaatggctcgtatcgcaggtgtcgatttacctcgtgacaagcgaatcgtaatcggcttaacttacatttttgggattgggaacacgactgcacaaaagatcctggctaacgctggggtttccgaagacattcgggttcgcgacttaacgccggatcaagaagaaaagatccgtgcagaagttgaccaaatcaaggttgaaggtgaccttcgccgtgaagtatccctcaacatcaagcgtcttcaagaaatcggctcttaccgtggcatgcgtcaccgtcatgggttaccagttcgtggtcaacacacgaagaacaacgcccggactcgtaaggggaaggccgttgccattgccggcaagaagaagtaatcattatttagaaaaggaggttagttaatctatggcaaccaaaaagggtacgcgtaagcgtcgggtaaagaagaacattgaaactggtgttgcccacatccactcaacgttcaacaacactctgattatgattaccgatgttcaagggaacgcagttgcttggtcctctgccggggtccttggcttcaagggtagtcgtaagtcaactccatttgctgcacaaatggcttctgaagccgctgctaagcaagcaatggaacacggtatgaagaccgtcgaagttgaagttaaggggccaggttccggtcgtgaatctgccatccgggcacttcaaacaactggtcttgaagttactgccattcgggacgtaactccagtaccacacaacggttctcgtcctccaaagcgtcgtcgtgtttaatgtgcatctacggcgatgttttaatcggccaggtgccttttacagaatacgattcacgttttgaaaggggtaacagagtagaatgatcgaatttgaaaaaccaaacatccacaaagttgaagaaacagacaactacggtaagtttgtcgtagaaccgttggaacgcggttacgggacgactctgggtaactctcttcggcgtgttatgctggcatccctgccaggggcagccatcaccagcattcaaattgatggtgttctgcatgaattcagcacggttcaaggggttacggaagacgttacgcagattatcttgaacttaaagcaagttgctttaaagattgattctgaggacgctaaggaccttgaaattgacgttaagggtccggccgaagtaacggctgccgacatccaaggtgacggcgatgttactatcctgaactctgaccttcacattgcgacggtttccgacggtgccgaattgcacgttaagatgaccgctgataagggtcgtggttactcatctgctgatgataacaagactcgtatggagggcttggcaattggtgtcttaccaattgattccatctacaccccgatcgaacgtgttaactacacggtggaaaacacccgggtggggcaaagcaacgactacgataagctgacccttgacgtttggactaatggttccttaacgccaaccgaagcaatcagtcttgctgctaagatcctcactgaacacctgacgatgttcgtcaacctcaccgaagaagcacaagtaactcaagtgatggttgaacgggaagaaacccaccaagaaaaggtgcttgacaagaccatcgaagaacttgacctgtctgtacgttcatacaactgtttgaagcgtgctgacatccaaaccgtaaaggacttaactgaacggaccgaagccgacatgatgaaggttcggaaccttgggacgaagtcattggatgaaatcaagctcaagttggctgaacttggcgttggttttcgccaagaagattaattaattatttaaattaaaggagggaacacttcatgagttaccgtaaattgggacggaccagttcacaacggaaggctttattacgtgatttgacgacgagcctcatcgttaatggttctatcaccaccactgaaccacgcgcgaaggaagttcgcaagaccatggatcaaatgatcaccctggccaagaagggcgaccttgcttcccgccggaaggctgctgcctttgtccggaacgtcgttgctgacgttaaggaagatggcgatgacatcaagatccaatccgctttgcaaaacctgtttgaggacattgcaccgaagtacgctgaccgtaacggtggttacactcggatcctcaagaccatgccgcggcgtggggacggtgccaagatggttatcttggaacttgtctaagcgagattaagttaaatacgtaataaagaatcactacgtttggtggtatagagcgctacgatggtgaagcattgcttctagtctagcttgaaggtcggaaacggcgcgcctcattcgtaagtgattttttatttacgcgaaaatttgctagaatggttaagatactgaaagccagaggaggaaaatacgcttggcgatgattgaagtaaaaaacgccacctttacctaccccggtagtgaggcgccggcgctagagggggttagcttctcggttccggctgggcggtggttagcgatcgtggggcacaacggctccggcaagtccaccttggcccgcttaattgatggcttgttgccgttggcggccggggagattaccgtcgatgggctaccggtaacggtggataacttaactgccgttcaccaacgggtggcttttgtctttcaaaacccagataatcaatttgttgggaccaccgtagccgatgacgttgcctttggacttgaaaaccagcgtcttccccgggctgaaatgcaagaacgggttgatcaggccctagcgcaagtcgagatgacagcctttgctgaccgggagcccgcccagttatcggggggacaaaagcagcgggtggccctggccggcgccttggccctgcacccgaaggtcttaatcgttgatgaagtaacggcaatgcttgatccggaaggaaaagagcagatcatgaccctgctaaaacgactgcaccaaaccggaaacctaaccattctttcaattactcacgacaccgaagaggcccgcttggctgaccagatgattatgatcgacgggggacggttagtggtcgatggcgaccccaaagaattgatgcaggatcgtcagttgatggaaacccatcaactggcccccacctttttagtgaccctcaaggaggcgttggcgacccgggggatcgccattccaagggagattagtacggaagacgaaatggtgaagtggatatggcagaagttaagttcaagcaagtaggctaccggtaccagggggctgatgagcagggaactcaggcggtggttgatctgagtgccaccatccccagcgggacaacggccgccattattggtcacaccgggagcggtaagtcgacgctgatgcagatggtggacgccctgatcttacccaccagcgggtcgatccaggttggtgacttgaccattgattcccagaccgctaaaaaggatctgattaacgtccaccgccgggtagggtatgtttttcaatttccggaaaaacagctcttcgccccgaccgtaatcgaagacgtcgcctttggcccccagaacctggggaaggatgccgaggaggccaagcaagcggctaaccgtgccttaaccgcccttaacttccccgcagaccgtttgcaacacagccccttggagctttcgggggggcagatgcggcgggtcgccttagcgggggtcttagcgatggaacccgacgtcttgatcctcgatgagccgaccgcggggcttgatccggctggtcaagaggagctcttaaccctagtggaaaagctgcaccaacagggggtgacggttctgatgatcacccaccaaatggaccaggtagctcgtttggctcaacaggtgttggtgttaaaccaagggagtctagtctttgatggacgcccggctgacctgtttgccgaccctgacttgcttcaaaaaaaccaccttcaggctccccagtcggttcggtttgcccatcggctgaagcaagcgggggttgaagtaggggcgccgctctcgttaaaccaactagccgatcgactggccacgcagttagggggtgctgacaacgatgaatagccgcgtcttgtttgggagctttgtccccgtcgactccgtcttgcaccgcttggatccgcgcttaaagttagtgacctgtttttggtacgtggtcattattttctttgcgaagggcccgttaacctacctactcttggtggcgatgctaggcgccatgattgggctttcaaaggttccactgaaaatgtattgggcggggcttaaaccgctgctgtgggtaatcgggctgacaattgctatccaggtcctcttttcatcggggggccacgtttactggcactggggcttgatggcgatcactagtggggggatcaaccaggccctcgtgattctcgcccggtttattttgattgtcttagcctcaacggttctaaccgcgaccacgccaccgttacggctagccgatgccattgagtcgttaatgaagccgcttaagaaaatcaaagtaccggtcaatcagattgcaatgatgatttcaattgccctgcgctttattccgacgatcatggatgaagttaacacgattgttaaggcccagcaggcccggggggtggatttcacctccgggagtgtctacacccgggtcaagcgcatggtgccaatcatggtgcccctgtttgtcggggccttccggcgagccgaggatctggcggtggccatggaggcccgcggctacgatccagatcaggagcggacccgctaccgtcaattaacctggcggcgccccgacagcattgcgctggcggtggtggtgatagtgtcagtgctcttctttgttgcccggattttgctttaagaaaggacggttcttgtgcaccgttataagataacctttgcctacgacggcagtaactttgctggctttcaggtccagcccggcgaacgaaccgttcagcaggtcctcgaacgggccgttaataagatcgctaaaaaaccacaaccgccgctaatggtcttcggttccggacgtaccgacgctggcgttcacgccctcggtcaggtcgcccactttgacttaccataccaaattccggggccgtccttggtgcgggccctgaattcaagcctccccctcgacgtcttggtgaaggaggcaacagaagtggcgccggactttcacgcccgctttgatgcccaccataagcgctaccgctaccgggtggtggggggggagttcaccaacccctttaagcgtaattacaccggccattacaagtacccggtcgacgttgaacggatgcaaacagcggcccaggacttcgttggtgaacacgacttcacctcctttgttgcctctgggtcgcaagcgaccagcaacgttcgccgcatcgatgaggtaaccgtggttcgggatgaagaaaacgacgaggtggtctttgacttcgttggtaatggttttttgtataaccaggtccggattatggtggccttcttactggagattggtaacggccgccgccccgtcgatgacgttatgcgggtaatgaaggccaagaaccgtgatctcgcccggggaacggcgccggccagtggcttatacctggtggaagtgacctatgattccccggcgaattcacaaaatgattgacgccaacgggtttaacgagtaaactactaaatggtatttcttttccataaattactcggtacacaatttattgtaaaagaaagacaaatattggaggaacttaatcgtgagaacgacatacatggcaaaacctggtcaagttgaccgtaagtggtacgttgttgatgctaagggcatttcccttggtcgtttggcttctactgtcgcatctattttacgcggtaagaacaagccaaccttcactccgcacgttgacaccggtgactacgtgatcgttatcaacgccgcagaagttaagttaactggtaagaaggcaactgggaagatctactaccgtcactccaaccacccgggtggtttgaagcaacgcacggccggtgacttcttagctaaggatcctgaaaagatggttgaacaaactatcaaggggatgcttcctcacacctcgcttggtcggaagatggggatgaagctgcacgtttacgctggtgaaagccacaaccaagcagctcaaaagcctgaagtactcgacattactaacttaatctaaggagggaacggaattggctcaacaagtacaatacagtggtactggacgtcgtaaggatgcaaccgcacgcgttcgcttggtacctggttctggtaacattactatgaacggcaaggcaatcgaagactacattccgtttgccaacttacgcgccatcgtgaaccaaccatttgccgctactaagacggaaggtcaatacgacgtcttggtaaacgtaaacggtgggggcttctctggtcaagccggtgcaacccgtcacgggatcgcccgcgctcttttgaccgttgaccctgacttccgcgatgccctgaagaaggctggtctcttaacccgggacccacggatgaaggaacgtcgcaagccaggtctcaagaaggcccgtaaggcttctcaattcagcaagcgttaatctacgggttacgcttatcaaaacaccggcttgccggtgttttttcatgcttacttgaggataaaagttaacttgaccgggttgtggtcggcgtagtcaaagtcggtgttgatgttagtggcggttgccgtgacgttgttagaaaccaagaagccgtcacaaacggtcaggtagttgacgccggagcgataggcaaggtcggtggaacgaacggtcggcaccgtttcgcggttttgggccttgaccatggtgaagcccttggcgaccatgctttggtccaagacggagacccagtcgggcactttttcttggctggcgaagtgggttagcatgtccttgcccagggcgtgattgtagtcaccgccgacgatcacgtagttgccggctaagtatgcccgttcaatgacggcgtttaaaagtttcatctgggccttacgcatcttaccgcccttgtcgtaggcggacatgtggctgttgattaaaagtagttgcttgccgttagtgaccgggatggtggtgacggcaaaacagcgatccaggtcggtaaacttggagataaagctgttggtgactgggtactggcgccgggtagcactgccaatgtggtaacgactcagcgttaaaaggcccgattgaacgctaccgtgtgggtcggtgagtggccacattaaaaaggccgagtggaagttattggcaaagacgtgaccgtaaccgtggaacttattttcaaccatcctgacctggttgacgtgcttggagcgggtcgaattggtgtcaatctcttgaaagagcatgaagtcggcttgttgggcttgcatgaccctttcaacgcccttagtatcggttaaaactaccgccttggagcgggcggtcccgtacttgccccgtgtcttggtgccgcttttaagctcgccggcgtccatgaagaaactaaactggtggttgtaggccccaaaaccgacgttgtaagtagtggcggtgtagaccttaccggtcgttagggtggctgcttgattgttgccgatcgttagtttctggtggtcgggaatccggtagtattggtgttgcatgtataaaacgtagcccccgaccactagtgctagggtggtgattaccgccagcaaggtcagggcgctcctctttaaaatccgcattgatctttcctctctcattgattttattagcataccacaggtgaaaagggttgctaaataagcaacgcccttcttgggatcacgtgattattactaataaaataggggcaccgctctgttaattaaacaacgtacgggaacgagggggaagttgattgatttaacgttaaatcgaagcttagggttggaaaagtcaaaagggggatagctattctttgtgaagtctgttacaattaaagccgtgatcaagttttcacaaactaaacagattgagagaaagcggggaaccccacatgtcaaagaaagttgctttagttactggtgccggccaagggatcggggaagccattgccaagcgtttagccaaggacggttttgccgttgccttagtggctcgccacgccgacgccttagaaaaggtgaagcaagaaattgaagccgagggtggtcaagccctggtggtaactgccgacgttgccaagcgtgacgaagtctttgcagccgttgagaagactgtggcagaattaggtgacttcaacgtgatcgttaacaatgccggggtagccccgaccacgccgatcgacacggtgacgccagaagaccttgattacgtctactcaattaacgttgggggcgtgatttgggggacccaagcggcccacgccgccttcaagaagttggggcacccgggtaagatcatcaacgccacttcccaagccggggtggtggggaacccgaacctgaccgtttactccagttctaagtttgccatccgcgggattacccaagtaaccgcccgtgaactagccgaagaaggcacgaccgtcaacgcctttgccccggggatcgtgaagaccccaatgatgtacgacatcgctcacaaggttggccaaaacgccggtaaggacgatgaatgggggatgcaaaccttcgctaaggatatcgccttaaagcgcctgtctgaagcgtctgacgttgctaacgccgtcgccttcttggctggtccagactctgattacatcaccggtcaaaccctagaagtcgacggtgggatgcaattccactaacatttaggtgagtggttaccaacctcctcgacaggttaagggccacgttaactaatcgtaaaattaaaatattaaacgggctggggaaacacgatttttcccggcctttttctattccttgaagtttaacgataaccgcgggcttagtggctaagtctgctagattgagtcgcacttccagatagcgtgctccccaatcacaggcctagtggctaagtacggacggagaacgatgcgtaccgcatcaaccccgtcctagcttagcccacgacctgtttgatagattgggtcgcacttccagtttaaatcttccacaaaaattagtaatcttccccgcctaaatgcggtaagatgaaagtacaattatctgaaaaatctgaggaggatattttttgtggctaagcgaaggagacggacaaagaagggggctaaaaagtccctctggctggtcgccgtcctgattattttaattgggttaatggggagttacgtgggctatcacttgtaccagcgccacgtccaggaacaaatcattgaaaagcagcaaaacgccaagaagttgttcattaaagaaattgcccccgaggcccaggcgatgcaaaagcagtaccacgtgatggcctcgattacgatggcccaagcaatcttggagtcggactgggggacgtcggaactctccgctaagtatcataacctatttgggattaagggaaccggggcaaactccaagttgctctcaaccaaggaatacgttaatggacagtgggtagtgatcaagggacgctttaaggtctacagttcctggaacgattcaattgccgaccacactaaattgatgcttaacgggaccgacaccaatcagcaaaactaccaaaacgtgattaacgccactacctatcaacaggccgccgtggcccttcaggatgcggggtacgcaactgatcccgattacgcttccaagttaatcaacgtcattaagtcttataacctccacaagtatgatgagtaaggagcctcaccactaatgaaagagctagaagaaaaaattcgtcaatttggaactgtgttacccggtaacgtcttaaaggtggacgcctttttgaaccaccaagtcgacccggttttgatgcaacacattggccaggaattcgcagcccgctttaaggacgctaagatcaccaaggtttggacggttgaatcctccgggattgcccccgccgtgatgaccgggttagccctgggggtaccagtgatctttgctagaaagcacaagagcttaaccctaaattccggcatgtacacggccgatgtctactcgtacaccaagaagacgaccaaccagatctcgatttccaagcgctacgtggataaaacggaccgggtcttgttgattgatgacttcctcgccaacgggcaagcggtagaagggatgttgcaaatcgctgaccaagccggggtggaagttgttggtgccggcatcgtgatcgaaaagtgtttccaaccggggtccgctgaactcgctgctaagggcgttcgggttgaatcgctagcgaaggtttcgtcacttgcggatggtcaggtaagcttcaaacaaacggaaggggaagattaagatggcgggacaaaaccttttgtcccaggggaagaccctgggcatcatcggcctaacccaaaaggactggccgctgttggtggcggccaaaaaactggggttaaacgtgggcgcttacgttgatcactcccaaccccaactaaccaagctggccgattttacgattgttggcaactaccgtgaccgtgacaagctgaccgaatttggccaaaacagcgacctggtcatttacgccagctccctaattgccccggttgccatcaactacctgaccaactttacccaggttccccaaggggttgcggccttggaaatcgtccaggatcgcttgatggagcgggcctttttggatgaaattaacgtcaacgtgtccccttacgtcacggtgatttcacttgacgacgtttaccaatcgattgactcgattggctacccggcggtactcaaacccatccaacgggggttgggcgaacagagcctgcggatcaatcaccaatcagacattgcctatggtgacgactacattcaaggtggggcttacctactggaatcctggattgaccacaataccgagtacagtctgacggtggccacggacggggaaacggtggttgcttacccgctggttgaagagtttttcaacgaggaccgggagctaattgaggccaccaccccaaccgaagttccggatgctatgcgcgacgaaatggtccggatcgccaccgaaattgccaagaagctgggctaccgtggtgtgatcaccgtccgtttttacgcaacggctgccggagcgttgtacgtgaattcctttgacctggagccaaccatctctgggaacatctttgacgaggtggccggggtaaaccaatacgaacaaatgctgcgggtgatcgggggaatggcgatccacgaactccaccagctgcagccggccgtgttagtgccactctacgataaccaattagcctccgctactaggcagcaggtcctaaaggaaaactggaagttccgcttcttcccggccgacacgactaggacgaagggcgtgaaggggttagtttgggtgactggtggcccagacgccttgctcagcgacctgttaaatcaggttgacacaaccgaaatcttgcggccgaaaacgtcgccaacgcaaccagcaccggaagaagaatagttaaggggcgggtggtttacgcttacccgctgaacttaaaatggggctccagtaaccttcggcatggccgatcgcctggggccttcttagtgtagttagggaagggcatcagccaggtatttcccgggaaatttggtataatgaaggttacgatttaaagagaggatggtattaggcgtgcagaaccaatcgatgttagagggaatgaacgataagcaaagcgaggccgtgttgacgacggaaggccccctactagtaatggcgggggctggttccggtaaaacccgggtcctgacccaccggatcgcttacttgattgaggagcgtcacgtcttgccgtggcacatcctagcaatcaccttcactaacaaggccgcccgggaaatgaaggagcgggtcgctaagctcctaggtgaggccggcaacgacgtctgggtgtcgaccttccacgccctgtgcgtacggattttacgtcgtgacattgaacagctaggctacaaccgggcctttacgattgccgacaccagcgaacaacggacgctgattaagcggatctgcgaggaacaaaacatcgacaccaagaagtttgaaccccggcaactgctgtcggcgatttcaaacgccaagaatgcgatggaggatccggccaccttttccaagaaccatcaacgcccctttgaccggatggtggcgcgcgtttacgaagcctaccaaaaggaactggaacgcaaccagaccctggattttgacgacttgatcatgaagacgatcgagctcttcaaaaaggcgccggaaactttgacctactaccaagataagttccactacatccacgttgacgagtaccaggacaccaacgacgcccagtacgaattggtgcacatgctggccgaaaagtacgaaaacatctgcgtggtgggggatgccgaccagtcaatttacggctggcggggggccaacatgaacaacatcttaaactttgagcatgactaccctaacgcccattccgtgatgttggaacaaaactaccgctcaacccaaacgatcttaaaggcggccaacgaagtgatcgccaacaacttggaacgtaaggacaagaacctctggaccgaaaacggcgccggggaaaaaatctcctattaccgggcccaaaacgagcacgatgaagcgcagttcattgtcaaaaagatccaagaagaacgggccaagcacaactaccaataccaagacttcgccatcctttaccggaccaacgcccagtcgcgggtgattgaagaaactttcctaaagtcgacggttccttacacgatggttggtggccaccgcttctacgaccggatggaaatccgcgacctcttggcctacctgaccttgattgtcaacccgttggactcgatgtcctttgaacgggtggtcaacacccccaagcgcgggattgggatgacctccgtcgaacggttacgggagtttgctcaggagtccaacttgccactgctggcggcggcccaaaacgttcaaaacgccaacgccatctcggcacggacccgcaataagatcgaagaatttggccagttaatcgccgccttacaagacgaggccaaggtgctttcgatcaccgatttgaccgaccaggtgctggaacggaccggctacctagccgaattgcagaaggataaaaccctccaggggcaaacccggcgggaaaacctggaggaatttaagtcggtgaccgccgaatacgaccgccaacacgaagacgatgagggaatggaccacctacaaaagctaaccgacttcctggccggtttagccctggtgtccgaccaagacgacgtcgatgaagcggaacccgccgttactttgatgaccctccacgccgctaaggggttggaattcccggtcatcttcttgatcgggatggaagaaggggtcttcccgttgtcccgggccatgaccgacaacaaggaattagaagaagaacggcgtttggcttacgtggggatcacccgggctaagaagaagctttacatcaccaacgccttttcgcggatgctgtatggtcacatccaacgcaaccggccgtcggagtttgtcgaggaaattacccccgaactgatgcaatcagagaaccaaaatcagggtgaacgctcgttaagcggtcggatatccgggggcaactcctacgcctttaaggccgccacggccaccacttaccagcgcccttctgatgcggggaagcgggtcgccccgaagaccaacaccgggaccggggccgaaaagaagtcttggaacaccggcgacaaggttaaccataagaagtgggggcaagggaccgtggtctccgttaacggaaccggagaaaacatggaactagacattgcctttccacagcagggggttaagcgcctcttagcaagttttgccccaatcaccaaggtggaggattaagatgagtaagcaagaagccgtaagtgagctaaccaagcaacaggctcaagcggagttaacgcctttaagagagcagctcaagaagtggggagcggagtattacgaacaggacaacccgagcgtggaggattacgtttacgaccgggcttaccaacgcctagtggaaatcgagcaacgcttcccggacttggtggtacctgattcaccaacgcaacgggtagggggggccgcggaaagccaactcaacaaggtgatccacgagatcccgatgctttcgatgggggacgtcttctcgcccgcagaattggcggactttaaccgccgccaacaagacaacagtgacgtcaaagttgattttgactacaacctggaacttaagatcgacgggttatcgttatcgttagtctacgaaaatggccgtttggtgcagggttcgacccgggggaacgggacgatcggtgaagacgtgaccgaaaacgttaagacgattaagtccatcccgcaggtcctgcccgaacccctctcgctagaatttcgtggcgagtgctatatgcccaaggaggccttcgttaagctcaatgaacgccgtgaagcggagggacagccggtctttgccaacccgcgtaacgccgccgccggttccctgcgccagctagatccgaaggtgacggccgcccgccagttggatacctttatgtactacgtgcccgactaccaagcactaggggtgaccacccaggcgcaagcgctcgaaaagatgcgggcgctgggctttgccgtcaaccccaactaccgggttgttcacagccaagcagaactgaccgcctacattgaggagtacactgaaaaacgggatcagctcccctacggaattgacgggatcgtcgaaaaggttaacgacctagcaacgcaggtggcgctggggaatacggttaaggtgccacgctgggaaattgcctacaagttcccaccggaggaacaggcgaccgtcgttagagacattgagtggactgtggggcggaccggtaacgtcacccctaccgccgtaatggatccggtacagctggcggggacgaccgtttcccgggcctccttacacaatcccgattaccttgccgaaaaagacattcgcctgggcgataccgtcttgttacacaaggccggtgatatcatcccggaaatttcccgggtaataattgagaagcgcccggctgatagtaagccctacgaagtgccgactacctgtccggagtgcggggccgacctagtgcacctcgatgacgaagtggcgctgcgctgcgttaacccaatgtgtccggcccaaattaaggagggcctggcccactttgcctctcgcaacgccatgaacatcgacgggttggggcctaagatcattgaacaactctgggataaggggatggttaaagacgttgccgacctttaccgcctggaagccgcgcaattgttaactttgcctaaatttggcgagaaatcgatcagcaacctattgacagccattgctaatagtcgtcataattcatgcgaacgccttttgtttggcttagggattcggcacgtgggcgccaaggtcgcccagctactagccgccgaatttaagtcggtggacgccctgatggcagctgacgccgcaaccatttcggcggttgattcgatcggcccgatcatcggtgacgcggtggcgacttactttcaaaacgaacaggtccaccagttgattgccgaactaaaagaggttggcgtcaacatggactacctggcccccaccaccagcgcaacggaaagtgccgagtgggccggaaaacgggtggtcctaaccggaaaactaaccaagatgacccgcggccaagcccaggagtggctgagtgcccggggcgcttcggtaaccgggagcgtttctaagaaaacggatctcttaattgccggtgaaaaggccggtagcaaactggaaaaggcgcaaacgctgggcatcgaggtctgggatgaagaccgctttgaccaagcgatgaaggaggaaaactagacgtgcgagtaaagaaaatcgtcttggccgccgccatcaccatggtggccgccgtgacgcttgccggttgtggcaagaagagctccagtagctcgagtgtgacaaccaccgggtcgaccagtggtaattaccaaggggtgatcgaaaacggtcgctacaagaccagcaaggcccgtggggtgaacacggcgcaaaacgctaacgtgtacaacttgaaggcctttgaatctgggttgaccaacgtttctaagctggttttctccaccaagagctacatcttccaggaaggacagtacctgtcttctagcaccctggataactggttagggcgcaagacgtccagcaacccaaccggtttaaacccagctaagggtaagagcagcgacccgaacccagaatacattcaacaaattgaagaacaagattacatgcagcaaagcggtaactctttgaagcttaaggggatcgtaatcgggatcggggtcaacagcgaatacacctaccaaaagaccaccgatgggccggattacacgaaaaacatctccgacgccgaggtacaaaaacagggtaagttagccgccgccaagattttaaagcggctccgggcccgtaaggacttaaagaacgtgccgatcgtgatcgccctctttaagcaggcctccgatgattcactggtgggggggaccttctttgcctacagcaagaataacggctccacgatctcatcttggaagactttgaactacaaggcggtcgtcttaccaaaggcgagcgattcgacctctagtaattccagtgatcagtccgataactctaacttcacgaacttcaagacccagattcaatccttcttcccgaacttaagcggggtaacggcccaggcccagtactacaacaactccctgtccgggatgaacattacggtcacgacccagttctatagtgaaaccgaaatccaatccttcacggaatatatcgttcaggccgccaagaagtacttaccaaacgggatcccaattgaaatcaagatccaatcttcgaactcaattcaagcggtcgtctaccgcaactctgggtccagcagttaccaatcgcacatctttagctcctattaaaaccaaactttgaacagagcccgtgggcccgcgcaatcggcatgccgaaactgcgcgggtcccttgttgttagcggcgcgaattttagccgcttgagttaataagtcgccctaactgtgataaaataaggaattgtataaatcatcaatgcacaaaggaaaagaggttgagagaatggctgagcaattagaccggcaacaggtcgaacacgttgcggacctggccaagctggcgtttaccgatgcggagttggacaagttcacccccaaaatcgaagaaatcattgacctgttcaaggaactggaagaggtcgatacgaccggcgtggaaccaatgagtacgccaacgacggaagtcaacgtgatgcgagaagacgtggcggttaagagcagcgaccaagaacgccaagccctgttggataacgctccggaaacggctaacggcttaatcaaggtgccagcgatcatcgacgaaagcgaggacggagaagagtaatgactttttacggtaaagacatttcgggtctgcacgccgacctagttgctaagaaggtgagtgccaccgaactgaccaaggccgcctttgaccggatcaaggccaccgatgaccaagtcggcgcctttttggccctaaacgaggaagcggccctcaagcaagccgctgaattagaccaagcgggaatcgcagaagaccaactgctggccggaatcccgctggccgttaaggataacattgttacaaagggcttgacgacgacggcggcttccaagatcttggaaaacttcaagcccgtttacgatgctacggtcgttgaaaaactcaacgccgccggggcaatcaacgtcgggaaggtcaacctagatgaattcgccatggggtcgtcaacggaaaactccgcctttaagacgaccaagaacccgtgggacctaacccgggtaccagggggctcttctggtggttccgcggccgctgtggctgccggggatgttttaggggccttggggtccgataccggtggttcgattcggatgcccgcttcctttaccgggacggtggggatgaagccaacttacgggcgggtttctcgttgggggctgatcgcctttggttcttcctttgaccaaatcggttggctgacccaatccgttaaggacaacgccatcttgatgagcgccatcgccggtaaggatgaccgcgacatgactagcgctaaccaaccggtaccggattttgccgccggcttaaacgaccaggccgacatcaagggaatgaagatcgccgttccgcgcgaatacatggaatgcctcgatgacgacgttcaagaagtgatcgaagcgagcctgaagcacctcgaatccttgggtgccacgatcgatgaggtttccttaccacacaccaagtacggggtaccggcttactacatcctggcctcttcggaagcttcttctaatttgcaacgcttcgacgggatccgttacggtttccgcgctgatgacgttaagaacctggaagacgtctacgttaagacccgttcgcaaggctttggggacgaagtgaagctccggatcatgctggggaccttctccttgtccgccgggttctacgacgcctacttcaacaaggccgctaaggtacgccgcctgatcgcccaggacttcgatgacgtcttaaaggaccacgatttgatcgttgggccaaccggaaccagcaccgcctttaagatcggcgccgaaattgccgatccaaagcaaatgtacttcaatgacgtcttgaccgtgaccttgaacatggccgggctaccggggatgtcgatccctgccggcttctccaaggacaacgggatgccaattggcctgcagatgatcggtaagcgctttgatgaagccacgatttacaaggccggttacgtctttgaacagacgaccgacttccacaagcaaacgccagaattaggataggggggaaccatttatgaactttgaaactacgattgggctagaagtccacgttgaattaaagaccaactcgaagatcttctccccgtccccggttaactttggggcggcgccaaacgccaacaccaacgtgatcgactgggggtacccaggggtcttaccgtcgattaacaagggtgtggtccgcgacgggatcatggccgcattagccttgcacgccgaagtgaccaagaagatgcactttgaccgtaagaactacttctacccggataacccaaaggcctaccagatcacccaatctgaaacgccgatcgcccacgatggttgggtggaaatagaagttgacggtaagaagaaaaagattgggatcaaggaaatgcacatcgaagaagacgccgggaagaacacccacaccggcagtcactcctacgtggacttgaaccggcaggggacgccgttgatcgaaattgtttccaaggccgacatcgcttcgccagaagaagccgttgcctacctggaagccctgcgccaacggatccaatttaccgggatctccgacgtgaagatggaagaggggtcgatgcgggtcgacaccaacatttccgtgcgcccatacggctccgaccagtacgggaccaagacggaaatgaagaacatcaactcctttaacttcgtcaagaacgccctgaactttgaagccgaccgccaccaaaaggtcttgatggccggtggtgaaatcgttcaagaaacccgccgttacgacgaagcgacgaaggggacggtggcgatgcggaccaaggaaggttctgacgactaccgttacttcccggaaccggacctaccgccgctggaagttgatgacgcctggattgaagaaattcggtcccaaatgccagaaatgccgggcgaacgccggcgccgttacgttaacgacctcggcctgactgattacgacgccatggttttgacccagaccaaggaaatggccgacttctttgaagaggccgtcaaggatggtggcgacgccaagaaggtggccaactacctgatgaacgacgttaactcctacttgaacaaccaacacgttgacctggacgacactaagctgacgccggctaacctggcggggatgatcaagttgatcgacgacgggacgatctcctcgaagatggccaagaaggtcttccaagggatcttggatggtcaagaaccggccgccttcgctaaggctaacggtttggtgcaactgtctgacccggccgaactgcaaccgattatcgatgccatcttagacgacaacgaacaatcgattgaagactttaagaacgggaaggaccgcgcctttggcttcttgattgggcaaatcatgaagaagacccaggggaaggccaatccgaaggtggttaaccaattactgggtaagtcactcaacgaacgttaaggaggaatggtcatggccaaacgagctcggataatttacaacccgacgtcgggacgggaagctctgcgcaacgacttggtcgacatcctcgatgtttacgaacaagccggttatgaaaccagtgcctttgccaccacgccggaaccagattccgctaagaatgaggcggcccgggcagtcaaggaaggctttgacctgattgtggccgccgggggcgatgggaccttaagcgaagtggtcgatggtttagcgggcctaaagaagcggccgctgttagcgatcatccccgccgggaccaccaacgattacgcccgggccttacgggtaccgcgcgataacccggtggccgccgctaagttgatcctggagccggccaaccggttcaagatcgacatcggtcaggccggtgataagtacttcatgaacatcgcggccgggggaaccttgacggagttgacctacgacgtgccgtcacaaatgaagtcgatgtttggctacctggcttacttcgccaagggcgccgaaatcctgccccgggttaagccggtcgccatggagatcacttacgatggtcaaacctttaagggcaaggcctccacgatcttcttagccctaactaactcggtggggggctttgaacaaatcgtcccggatgcttccttagatgacgggaacttctccttgttaatcatcaaggattcgagcctcctgggcctgatgcagctgatggccaaggccttaaacgggacccacattgatgatccgcgggtaatctacgtgaaggccaaggacgtaacggtgaagccccttgatccaaacgatcggttaatgatcaacttggacggggaatacggtggggacgccccgatggaattccataacctgcaccagcacatgacggtcgttgccaacatggaggcgatcccggatgacgcgattaccagcgacattacgccggacatgcaaaaggccgaagacgacttcgtgcgtggcttgggcgaaatggaaaaggatacgcaagagtaataattagctaagtagggacccaaccgttaagcaaacgcacgggcccctctttcttgtaatgggcgcaattacggcgcccgttgtacatacaatatacggaggaaagcaatgagtaaggtgcaactaccagttcataaaaacgaaacggtcacggggacggtcctcgacctgacttaccaagggaacggggtcgtcaaggttgatcactaccccatttttgtgcccaacaccttgccgggcgaagaggtaacggttaaggtaactaaggtgaccaagaacttcgcctggggcaagctgatcagcattgaaaagaagagcccggaccggatcgatgaccccaactgggcctacctacagacggggattgcgccgttagggaacctgacttacccggcccaactcaagtttaagcagcgtcaaattcaagaactcttggaaaaggcccacctaaacttagaagtggccgaaacgctggggatggaccagccctttggttaccgcaataaggctcaagtcccggtgcggatggtcaagggccaaccgacgaccggtttttacaaacgtggtagccatgacctggtgccaattgaagacttttacatccaggacccggcaattgaccaaaccgtttcggtggtccgcgacctcttacgtaagtaccaagtgccggcttacgatgaagaaactcaccgcggcgtaatccggacggtgatggtccgccggggctactacagccaccaggtgatggtggtcctggtcactaacggggagcatttcccgcacgtcgcagaaattacccgggaaataagtgaacgggtgccgggaattaagagcatcgtgcaaaacgtcaatgataagcggaccaacgtcattttgggaacgaagaaccacctgttgtggggggaaccaaccatccacgacaccctcttggggatcgacttcacgatttcgccgctctccttttaccaggtcaacccgcaacaaaccgagcgcctctaccagaccgccattgaaaatgccggactagacggaagcaagaccgttatcgatgcttactgtgggattgggacgatctctttagccgtggctaagcacgccaagcacgtttacggggtcgaaatcgtgccggccgccattgcagacgccaagcaaaacgccgccaataatgggatcgaaaatgcgacctttgttgttggcaaggccgaagagcagtttgccaagtggcaagccgagggtctcaaacctgatgtggtgattgttgacccaccgcgcaagggcttggatgcccaattgattgaggccaccggtaagatggcgccccaaaaggtgatttacgtctcctgcaacccggcgactttggtccgcgacttacaacgcttcgccgaacagggctaccacgtgaccaagccgatccaaccggtcgaccagttcccgcagacgacgcatgttgagagtgttactgtgctggaacgtacagaaaaatagccgacaagccgcgtcataacggtatttacagatgattgaaagtgtactttttcctttctaagtgattggaattagtacactttttctatttaaggtcggcgggtcgagtgctcaatgtcctatttcgatagtcgagtatgctaatgtccagtttagcaggtcgtgttgattagggtagtgaaaggtggataaaaaggctgatatagtagcatttatagttagtgagaatagaataaaccattttgaaatagaacaggttaataggacgactagtgagcactggaagttgctactattagcagattcaaataaagagttaattcagaaatatttacgactaggcagtccatggttaaaaacgaatagtaaattggttttaatgtcgcctacttgtcgccttgttgtcatgctgatgtcgtgttcatattttccgggaaaagttataataaaagtagacttagattgagaggagatttttaaaatggtcaacaataaaattaagcaacttagacttagcaagaatttatctcaggagcaattagctgaaaaggcaaaagtctcggttaggacaattcaacggatggaggccggggatgatgctagcattgagacattgaaccttgttgcgggagctttgggtgtatcagttaaagaactttttgatgactcaccagctcaaaagaacaagataagaaatgcagaagaaaatctccaataccagcttaaaaatcggcatgatgaatttaagacctttaagcatatctatttaacatgctatataattgttatgatgttgtggggagtatgctttgatttccttcataatgacgcttggtcagccatcatgggagttctttggattggcggctggatgttgatgggacagttaacaaagttaattaccctcaagtggattgatccaaagctagatttaaaatatcccttaactgctagtcggatagataaggatagagaagataaataatttattctaatttcttatggtggctgctatttattcgctgaccaacttagccagccggcttattgattatatcatgaacgattttcgttgtcaagaagttttttatttaactttttgacaacttttcgttcgttgctggattagcaactcttataatataacagagttaccatccgctgtcaacaactttttccaactcatcttcattcaaagtgatatctgtcgtgacaacggtatataactatacagacaataccgcaaagtgtcaatagaatttagtatatattttggatttttacaaaacacgaacgttataccgaagttccatcctagatcaaaaataattcgaacaatgatggtttgttcaacgtaatcatccttttaatgttcatttagatcctaaatagggactttccttcacaattacatgacgtcttgatacaatttaccggtaattaaccatatttttaaaggagccatttatgtcgaccttaattgatttcattttgcacattgacgtacatctgatccaaattgttaacaactttggggactggacctacctaatcctgtttgccatcatctttgtggaaactggcgcagtgatcctccccttcttacctggggattccctcctctttgccgcagcggccttagctgctaatgctaactacaaccttaacatttggatttttgtcgccatcttcctcttagcttgcctactgggtgactcatgtaacttcatgattggtcataaaattgggaaggaactatccaatcactcccttttcggacgtttaattgataaagatagcctcgccaaagcggaacagttcttcgaaaagcatggtgcgccagccattatcttggctcgttacatgccaatcatccggacctttgctcccttcgccgccgctggttctggctttgcctaccacagttttattcgttacagcgtcatcggttgtatttcatgggtcgtaatttgttgtggtgcgggttacttcttcggtaacctccccttcgttaaggcccatttctcattaattatcctagcaatcatcgttgtcacgttaatcccggccatcgttggtttcttcaaggcccgtttccaaaaagacgaagcggcgtaactcttttttcacccaccgatagattaagtaaatgagtccctcgaccaaaagcccccagctaatggctaatgtcataaaaaagctggttggccacaggttgatgaggggctctttttttggatcaaaaagccaatcctggtttgaaaaggcgtggtaatgaaaccacaagaagactggttcaaaatttaatccaattaaaattaccgccactaaaaaaccaattagtagccattgcaaccacccacgcaaccgccatagttgatagcgctgcttagcccaccatagcccccaccagctcactaaactcgcgccaaccgttatagactcacccaataagaaaaggtggcggacgtctttaaagtgacgcagcacctttgcatccgtgggcaaataatcaagccgcatcgtctcccctgaccagggaagctgtaaataccccagaattcgtaagtaatcgtgcccgacaattcgctgactaactcccatcaaacgcccatctactaagaaatatgaagcgttcgttaccaaaaaaagggcgccacccaagcacgctagcataattgctaacgcgattagaagggtgcgcccctggttaattaaattattccaccatccagtcatctaatgaatccaccacatgggttggtgggacctcctctcttgccacctgctctttagtcgacactcccgtataaaccaggagcgtatccatgcccacgttgatcccagcttcaatgtcggtgtggtaattatcaccaaccatcaccacttgttccttagttaacccgacccgttgtaaggccatctccatgatgatggcctctggtttaccaatcatgatgggtttcgtttgggttgcgtactcgaccaacttgactaacgaacccgctccgggagtcagcccccgctcattaggaaggttactgtcggcgttagtaccaatgaaggtagcccccgctaaaattgccaaaacggcaacctccagcttgcgataggttacctcggtatctaagccgaccaccacaaaatcagggcgctggtccgtcaattcaaagcccctgctttccaacgcatcctttagcccttgttcaccgatcatataaacccggcggcggtctccggcccgcttagccaaataatcggccgtcgccaaggccgttgtgtagatctcagccggctgggccggaatttggtggttagtgactaggttggccgccacctgctcaggagaccgcgtcgaattattggtgacaaagagcacccgtttgttagccgcgtgcaggcgccttataaaactaggggccgccgggatcttctccttgccccggtacatggtcccatccaaatcaatcaagtagccttcgtaactctcctgcttgctcattagtcatcctttcgcgtccgtaccactagcttcgttcggttaccctttcccttcacacgccgtacctcttggtgccgtcgcttgcttagcgccggttctttaaggggccttttctcttcactgatctccgctcggccacgccgccgcgtccgggatttccgtggtcgcttggggtgagcaacctccaggttttggatgataaagtaaggacacccaaagttacactcttccatcaggtaatcattaatgcatcctacgccctgctcttcctccccttgcccgggtttcgcgtaaaagccccgcaagcgcaactggtcatacccccagtcaccgacaatgtaatcgtacttcgtcaacagggggctaaaacggtcggctaagctatcgccgttgaaggcctcccggtagtttttcttcagtaggtaggggtggccattgagggtgaaatgggtggcgtcttgtaacgtcacctggtaaagcccctttcgttggctcatccgttgctcaattaattcttgaatccgtgcccggttcacctaggtcacatcctttcattttgttatcataccacgccattagattgattgaccacggcaacctttttggccatcatctccattacctctggcaacgacaagggagtcccaaaggggggacggggcgttaagtagtcgagctctggggcgtcaacgccgacgtttaaattagttgtcgttgggaccatgtaatggtgaatgtggccgtgtaagttaatgatcttgggcgcaattcccatcatcattgggtagtgggtcaagtagagctggtggtggtcgtacttaattaacttaccaacgtcatgaaactcatacttaacccgcttgccaacccttgggttgtgagccgctaagtatttaaacaggctacgccgatcatgattccccttaattaacactaggtgaccgtttaattgaccaaggagggtcgcaatttgctcattggcaacccgttctggttggtggttttggtagttaaccgcgatatctccaaggtggtaaaccgtatcattttcctttacccgggcgttccaagcctccaccatcacttgatccatttcttcaacggtctggtaaggacgaggcgcaaactgatcgactcccaatagttgctcgtgaaaaaagtgggtgtctgagattacatactccattatttcctcctaaacaaaaagcgggaaacccgcaggctccccgcttcttcaaacccttaggcttgcttgcgaagtcgttcgatatcgtgaacgatcatcaattcttcattggttgggatcaagagaaccttgatcttagcgtcgtcggcagaaacatcgcgttcttcaccgcggacgtcgttcttttctgggtcaaccttgaccccaaagtaagctaacttgtccccaattgattggcggaattccttgtcgttttcaccgaccccggccgtaaagacgattgcgtcagcaccgccaagctcagctaagtaggaaccaatgtacttgagaacccggttttcgtaaatttcaagcgccagttcacattgcttgttaccgtgttcagcggccgcttgcacgtcacgcatgtcggcggacagttcagaaagacccagcaaaccagacttgtggttcaaaagctcgatcatttcttcgctggaaatccccaacttagattgaacaaaggcaactaaggacgggtccacgtcccctgaacgggtagccatcgttacccccgctagcggggagaatcccattgaagtgtcaaaggacttaccgttcttgatggccgtaatcgaagcgccggcaccaatgtggcaagtgatcagcttcaagtcttccagtggcttaccaagcatttcggcagcccgggaagcgacgtaacggtggctcgttccgtgggctccgtacttacgagcaccgtatttttcgtaccattcgtaaggaacggagtagagtgcgttcatttcaggcatgttagagtggaaggaagtgtcaaagaccgccactgcaaaggcgtccggcagcacccgcttgaaggccttgatcccttgaagttcggccgggttgtgcagcggtgcgtattcagccagttcatcaatcttttgcattacgtcatcatcaatgaccacggaatccttgaagaattctcccccggcaacgatccggtgcccaacggcagtaatttcgtggtattccttaacaatccccaagttgatcagttggtccaacagataggaaaccgccgtcccgtggtttgggaacggcttttcttcttcgctgacttggccatcgccgtacttaatcttggcgtgacccatgtccatcccgatccgttcgatgtttccttctgcaacaacttcttcacttggcatgtcgaacaacttgaacttaacagttgagctaccggcgttaacagcaatcgtttttgacattacaaattctcctttatttggcgggggctaagtattgggccacccagttatcaatttcacggataaaggcaataaattcaggacgattcttgaccgacgggaatgagcctaataagaccttgcccgcttggtgactagtccccccctgacgttgcaacaagaggagcgacttggctaccgttgagttagcaaacagttcctctggcaggttaatcaacccttgcatgtacgcaactgattggatccactccaccaacccagccgtttccttgctttgaaacagtgccttgggaaccaagaagaccccaaagccacccggcaacaagtaattcatcgcctgctcaatcaagaggtggtgaacataggaatgaccttccttggcccgggtgcggtaccgcttagtgttgtcatccagcgggtagtagcccaccggtaaatctgccaccacgaggtccacttggggaacatcgaggtcccgaattgcatcctggtggtacaactgaacgggaaggtcctggagttgggtcgaaacggccgccacgctgagcattgattcatcgttatcaactccgtaaccctcgattggttggtcggtaaccgattggagatgattcatcaccgtggtcagcaagttagccgtccccaccaccggatccaggatgcggtacgggtggtcaattttggtcacctgctcgatcaacgaggccatcagcatcccgattgagtcgggggtcatctggtgggtcgcttgaatggcgtccttttgggtcaccttcaacatccctagttgcaatagccgtcgcttggtttcccgatcggcctggctcaggtcaattgactggtagagcttcgttaacttttcagtcgtttcagcgtccggcaccccgtcttcaacccgtactgttcccccatccgctaggttctcggcgttttcgaggaaggcatcgaggtaagagcttgctaaggccgtttgaagcagttgcgttgcttgatcaaacggcgtgaataacgtttctggacttaaacgttccagtcgtggtcactcccttcaaaatcctagataaaccaattttacctagtttcgttcacaaattcaaggaagcccttgctttcctaatttaccgtgcctccttcacttgcttttcccttgcttgtcgcttgtgaatttgcctgccgtaaattttgtcgcgccgcctcttgttgctcgcgaattaactgcctcgtaatccgttcctgattggtcatgtaattgctgacgataactaaaatccccgtcacacattccattgccaggagcgccagtaggatactagtcgcccggtgccgcaaagcataccaccgccgtttgttcatgtcgtccccccgtataagtaaacctgacccgtctttggtcgacttgctcccaggtcaatttagtggcttgaccttcaaagatcggcaaaaagcctccccttccttcggttgataaatagatatactgaccggatgcctgccgagagagccggtacgttttgttcgttgtcttgctatatacactaaccccgtttttggcgacctccactagctgaaactgatgatccttggattctagctcgctgataaacaagtaccaattggttggttctgaagcgtcgaccttggttaaacggccatacccacccattaccaggccaaacaggttcaccaccaacaccaccaatgctaaggctacgattgcttcggccattgtaaaggcccgctgtcgcatgctcattcccccttgatttcgactagggtcttgttcccgataaaggccctggccccctgcctcgttgcctgcgctcggaccccctgccgactcagtgccacctgatcttttcctagcgcaatttgatcggtcgcctccttaactaagcgactggcgactaagttttgttctaattgacgacgcttgaccccgacttgctccgttaccaccaccaagctggcgaccaccacgcccaaaatcgttagggccaccagttgctcagccagcaggaaagccccacaccgcagtcttttgaacatagtatcccccccaacccatctgaattttcatgtcgtagttggtcatcgttaacttggaaacaaaggaccaggtccgcggactaacgtagccgtttttgtaaatcttgaccatatcttcgttagaggcaatgtgaagttgtttgggaagtagtacctcctccgttaccttcttcccactatcagtgtgatactcaaatctaatttctcgcttcgatcggctcgtcaaatagataaaggtcgcctttccctctacccgggcccgggtttgggcctcttgccagcgctgcttaacgtcccgccaaaactgttcctcactcagctcggcgttccttttttggtaaggaatggtggtggtcacgatcactagggcactgatggccaatacgatcacgacttccaccatcgtaaaggcgcgccgttggctattgaacaacggcctgaccattttggagcgtgatattttcgcggctagcctggcgaacctgcttagccgttaggtaatcacccttttctagttgggacaaatcggtcgggacgtcacccgtatcgtcatggtatagctcaacctggttttgaatcatgttgactaaggcctcttggttaaccgaagtggcgtgttttctttgcgcccctaggttgggcacgatgatcaagattaacaagctaataatgaacaagacaatcgtcatttccaccagggtaaagcccttggccacccgttttttcaatttctttaacattattccaccacctgtaatgattgatagattggcatcaggatacttaaatacatcaccacaaccacagcagctatcatcaccagaatcagcggctgggttaactccaacaattgcgacgaccgtgacgacaagcgctgataatttaaccgggccacggccgctaattcctcccctaattcccgttgggttaggccccggtttaaaaatgaaggcagctcccttggtaagtaatcgagatgtgaaacgacggcttctagtggtcgtcctcgcgctagggctccactgatcttttgaccaactaaataaagcatcgagcgctgatcaaattgaccaaccagccggctaatttcttgtagggacatcccgttttcgaccatcacggctacgttggccactaggtagtaggaccagtagtacttggtgggtcgcccaattaccggcagggtgcacaagaagcggacgcgctgctctgggtccattgtcatccaccggacgcccaacaggaccactgaagcgagtagtgcccccgcgcacgttaaaccaattgtggtaaccaacgggggaatggccagccccgccccgctgccccaactagcgacctcggggaggacaaagtgaatcaccattacgatcactagaactaaaaagaccagtaaaataaccgggtactgcatgaccgcccgtaaacgggcccgttgctttgcttgcagtgccatgaacttgcccacctggtgaatcgtttccgccaacttaccatggcgttctgccaagcgtagttggtagtaagtatcgaccgaaagccaagggcccagcgcctcggcaaagggcttgcccatgagcattgcctggtcaatttcatcaaacatcccctgccacttcgggtagagccgttgtgacatgtttaccagccggcgcaggctaatcccccggtcaataccgtcccccaagaataagagccagtccgccatttgcccctgtttcattttaaccggccgcgaattcttccgccgtttcctgcgtaatcttcccatttgctaccgcctcccctaagtgtttcacccacagtggggtcaccttcctcgtttccttttcctgccccggactggcaaagtcaaataacaccgccgccccttcgctagctaggggaaccaggcgttggtaacaagccccagttaccgcttgggctaactccagttcgctcacccccagttggcgtaggcgagtgtaaaccccacccgcgctacgggcatggaccgttgctaaaactagctgcccggccaaacccgcccgcaccgccatcttcgccgtcattgggtcgcgcacctcgccaatgatcaaaatgtggggacggtggcgcagactcacccgtagcagttcttgataacttaaccccgccagttcgttgacctgggtctggataaaccagggctcttcgatttcaaccgggtcctcgatcgtcatcaccacctgctcttttttgacttcgcgcgctaaacggtacatggtggtcgtcttccccgatcctaggggaccggcaaataagaccagcccccgctggcgagcaaaccggtgtaagttctgccattgagtgggaaccaggagctgatagtcggtgctaaccgggtagatgaagcggatgactaacgattcttgccccgtaaaatcacccacggttgataagcgcaggttgaccacaccttccttactgggccaactgatcccgcctgactgtggccgccggtgctcagtgaccgccatattggcgcggtacttaaaataagcgattagctgttgtcccccggccagcgtcaacgaacgccgttcctttacctgcccccgttcaaaggaggctaaccggtagcgaccctggtggggcaaaatataggcatcggccacccgctcaccgatcatggtggccatctcttttcgtaaccaactttccacgttaatccctccttgtttactaagtacggaggacacggaaaaagtgacgaaattaatggcaaaaaatctagggcgctaaaaaggccgagggaacaattgggttcctctcagcccttggcatttccgattatttagttagagaacgtaaggtatttaatcctacttagttgtacggtccctttgaccaggccttatttggatgctgataaacggtaaagggtcgcattggtacttcccatggcacccacgcctttggtttggctacttgtgccaccatatgcactggcactcaccttggtaccgtatttttttgacccacttaacaattgcgttgttattggtgtggctcgaaatgtagaagtatttaaccttcccgtccttgaccaattgcttaaatttcttcagggaaattgcgttatcggtcccgttatagcccccgatcgtcatcacggcctgaccggtcttgatgatgtacggggcggccgtattggaatcggtggtggcaaacaggtaggttgttgacttgccattatgttgtttaaggtatttgatcagttgggtattcaccgtaccagtgccaagtccggtggccgcaccgccacgactcagtagggacggtccggtggtcggaacggccgcggattcaccagagatcgttgaggtcagggcccaaaaacccggagccaaacagaggaaacctacccctaaggttaaaaagaggcgttccttagctgggatcaaggtcatcatgaccaacgcaaccgcggtcaaaatcaaaataactaaacttaaccacggatagtaagcccaaacataataggactaaaggcaagcggtggtccctaagcccatgaataaaaggtaacgcaaccagcgcgccctcttatcatcccttttcgacgtggccttttttagcccacttgtaatggccagggccgctaataccgccaacggaggcgctagcatgatggtgtaataaggatgaaagaagttagcaacgctaaagaaggccccaacggggattagccaccccgcccaataaagaacatcttgttgcttccggttagtctgccaccacttcttcttacgatcgtacgcagccaagtaagccgctaccattccaaaaagggccaatggcaagaaccagctaatttgccgtctcaatgccgtctggaataggcgggtcaccccagcggtcccaacgttgaagataccattgccaccttggccagcgccccccttcataccagttgggcgtcccttggtggtttttggcatactacttaacgacttgccggaaggcttccccccgtttgtagtccccttcttcatcccgctggttggcttagcctgcccagttggggctccgccagctggcttttttcattcccccctgcttagtaccacccgttggggccccggtcttagttttaccactcgctttagtccccatcccagagaaagtccccccggttccagtggtttgcccaaataaccgttgcgtcccgttataaccgaacgctaggttcaaaaccgagttggttgaagaactcccaatgtaagggcgcatacttttacttgtcgaatcgaccgccaggggccaactgaggctaaccacggctaaagccaaggtggccaacacggtctgagtaagtacccttttccaattctgccgactagcaacccagtagtaaagatacatggccggcaaaaccatgtatgcctgtaacatcttgatgttaaaagcgacccccactagggcaaaggataccaataccagccatccccgtcgctttcgaaccgccctttgtaaaacccaaccggctaacagtaagaaaaagaccagcgtggcatccatgttgttagttcgggagtcggtgaccacgatcggggtgattgtcataaagaaggcggctatccgtgcggttaagggaccaaaagttggcttaaccatcttgtaaatcaaatagaccgacccgattccaaacaggaccgaggataaaacgatactccaaccgtgaaggccaaagattttaacacagataaccataaaccagagggctaccgggggtttgtcgacggtgataaacccagccggatcaaagctagcataccaaaagttatgccaacttttggacatgctaacgatagctgccgtgtaaaaatcgttagcactgcccgcctcccagatattccacccgtacatgaataaactttgaggatttttacgctaaagcggggttaattgtttataaggttcttaacgatcctggttttataaataaaaaaagctgcgacatccctatcgcagctcctttggggaaaaaatgaaacacccttattagttgataaccacgtagtagcttggcgtgtaagcggacatgctcgtgatcttaaccgtttgaccagtatctggggcttggataaaggtcccgttcccgagcgaaatcccgtcgtggtacggtgcactatcggagccaaagaagacgatcgccccagccggtgcgttttcaacgtcgtaatggtgggttcccaaggcttgttgttggtaagtcgtccggtaagtagaactcaggccatatgcccattgaactagcccggagcagtcaaagccgctcgtggtatttccaccgtatacgtatggtgtaccgattacggattcggcacgggccaccgcttgggcggcgctgtaagtagccactcccgacgtgcttgtggtagtcgtggaagtgatggtcgttgatgaagccgttgatgagcttgctgaggacgcactagtggctgagaccgtcaccatcgtggtgttggccgtactcgtggcggaagcggagctagcagcactggaggtggtggcagaagatgccaccgcactcgtggctgaatcgctagatgcacttactgcagagtcggcactagcaacggcggaactagcactaacaacgttggttgcgctcgtggtactagtagcgctagaatcagcagccgaattagcactaactacggcgctgcttaccgcactcgtagcggacgtgttcgtggccacttcactggcactcgaactcgtcacactcgagcttggcgctgagttagcactagtggcgctagtagcggtgctcgtcgccgttgaactggccgtggccgccgtgcttgaagcactggagcccccactcgttggaatataaatcgtctttccggcaataattaagttcgggttctttaagttatttgctttaacaatgtcacccatcgtcacgtggtagcgctgtgaatagccccacaccgtgtcacccttttgaatcgtgatcgtgtctgcatgggccgttgctccggcggctgcaaggccaatggttccaaatcctaaggccaccgtgcacttgagcatcagtttcgttttgataatccttcacatccttatattatttatcctttcacaaggacccccttaatataaacgaaagaaattaccagaccattacagaaggtatacaatagattgttataagtatgatatatttatgaatatttacggtaaaatatcatttgtaacgattgacaccgttcgttacctagctgttaccaaaacgaaaagaggttgagagaaacacgagtttctctcaacctctttacttaacttattcgccctggtcggcatcttcaacgaaggctgcttcgtaaacgtcagccacgtcatcgttgtcttccaattcatcgatcaagtgttggtattgaccaaccttgtcggcaggaaccttggtcttgttttctgggatcatggttacttcggccgtttccagttcgtagccttgttcttgtaaggcgtcacgaacggaagtcatggcggaaggatccgtgaagattttgaacttgtcgtcagtggcttgcatgtcgtcagccccagcgtcaagtgcgtccatcaacatgtcgtcttcgtccttgtccaagccgtcacgaaggatttcaattaacccttgccggttgaacatgtaggaaacggaacccgtggcccctaaggaaccaccggagtgagtgaaggcggaccggatagcggcggccgtccggttcttgttgtcggtcaggcagaagaccattacggctaccccaccaggaccgtaaccttcgtaagtgatttcttcgaagttggccccaccagcaccagtggccttgtcaatggcccgttggatgttttgcttaggcatgttagctgcccgcgccttatccattactaaccggagttgagggttgttgtcgggatccgggtcacctgctttagcggcttggtacaagtcacgtgaaatcttttggaaaattttaccacgcttggcatcctgagcgttcttacgtccttggatgttatgccattttgaatgtcctgacatgaactaactcctcttttctttaaatgataacaaacagtcaaattatactaaatcatgggcgttttttcaagcccgtctgctaaaccgccgccagacccgcaccaataggcagagcaagaagatggccaccgggatcaccactaaggaccagcccttgttcacaacgtcagtctccacctgtgaaactaggggcgccagggtttgatcatcggtgatcgcccccgaccagagttgcggcaagagcaatagtccgctaaacaagaggctaacccaggccattgcatcgccaattgtaattggaaacgagaccgttcgcatgaaagtggcggtcactaggcacagggccaaaacgaccaaggacactagtagtaccaagttggtgattaccttgcaagttttaatggcgctggctgcttcctggagctgactcgtgtttaactgggaattgacctgctggcttagctgattttcaatggcggcaatcgccgagttgttggcgagactaaccgaaattcccagcgtcgaagctaattgctcgctagcctggttcgtaaggctactttcaatgctcgagaggtcgacttgaatcgtcttgtcctcgtaaacctcttcgaccacttgctcgattaactggttggcttgcttggtggttaccaccgttcccgagtaaccgtactggctcacgctttggttgatcatattttgtagggaggtcgctaaactggaattggttagttcctgtttagcaaaggactcgtttaacaccgttccattgatcaaaatggtgatcaacagggtgagggtcgctaaaaccgttagcaaggccaagaagaagtggtgcccaattcgtggccctaagtcagcttctaagggggccgccgcttgttcttggtgccgccgttggtactccgctcttgagatcaagccatcacccccagtgattagcgggtcgtttgccgttcttcaaacccgtgtggcaagattacgttttgctcgtcatcgccatcttcaccatcggtagcttggttgttacccatcagcttggtcaacaggcgcattgaaacggcaccaatatcataaagtggttgggtaaccgaagtcatcttcggccgagtaatttccgttaacttagtgtcgttagcggcaatcagttcgaaatcggctggcaccttgctcccgtggtcggtcaggccgtttaacagcccggcggcaatcccatcgtcggagacaaaggcggccttggcgccactttccagcaccttttcggttaggtcgtaaccttcccggtaggaatcgtgagcttcaaaaattaaggcttcatctaaggactggccggcctctttaagggccgcttcataccccggaatccgcatctgggcattgatcgtactggccttagagccgatcaccaaggcaaccttgtcgttaccgtggttaagcaggtattgaacagcttctttcgttgctgcttggtagttgatccgcaccgttggcaaatcttcatcgttgatggcagagccggcgacgaccaccggaatcgtggaggaagagaattcttgccgcagttcttcggagatgtcgtggcccatgaagatgatcccgtcaacttgcttggccatcatgctgcgtaccacttgtaaggccttgtggtcatcggcatccgagttggtcaaaatcatgttgtacttgtacatggaagcaatgtcgtcaatcccgagggctaacttggagaagtagtcgttggtcacgtccggaatcacaacccccaccgtggtggtcttcttggaggccaggccccgggccaccgcgttcgggcggtaattcaattccttgatgacgtctaagactttcttacgggtttccggcttaacgttaggattcccgttgacaacccgcgaaaccgtggccatcgagacccgggcttcacgcgcaaccgtgtaaatggttactgattgtttttgcatgatgctctccttcttgatctattatgttttcatagagttttcaatccaatccataatatagcaaagttccctttaaagggcaactttatggatcaatcttatggtaattttgcgttataatcgacttaatcgctgttacaagacggaaaggattgatttgatgaattacgaaaagttgcaccaccttcaacaactgctagccgaccaacaactagacgtcgcctatttgagcgacccaatgacgattaagtacctaaccggttttggttcggatccggttgaacgggtcctcgccctgctggtctttgctgaccaggaccccttcttgtttgggccggccctcgaagtcgaagccattaagggcactggttggccctacccagtctacgggtacctagaccacgaagcaccgtttaaaatgatcgctgaccaggttcaaaaacggatcgctaaccctaccaagtggggtgccgaactaggctttttgacggtgacgcggttacgggccctggaagaacaattcccggccgcccactttgatttcgacctgacccccgccatcgaacggatgcgcttgatcaaatcggccgatgaaatcgaaaagctcaacgaagccggcaagtgggccgactttgccttccaggtcgggttcgacgcagttaaggttggccaaaccgaacaggccgtggccgccgaattggagtacgccttaaaaaagcacggcatcatgcagatgtcgtttgacaccctgatccaagcgggcccccacgcagccgaaccgcacggcgccaccagtagtcgccaaatcgaaaataaccaactggtcttgtttgacctcgggacgatttacgatggctacatctccgacgcctcccggaccgtggccgtcggggcgctcaacgatcaacaaaaagacatttaccaagtctgcttagaggcccagttaaccgcccaggccgctgccaaaccggggatgacggccgctgaattggataaggtcgccagagacgtgatcgaacaggccggctacggtgagtacttcatccaccgcctcggccacggaatggggatgagcgaacatgaatttccgtccatcatggaaggaaacgacatgcaactagaacccggcatgtgcttctcaattgaaccggggatttacatcccgggcgtggccggcgttcggatcgaagactgcgtccacattaccgaagacggctgcctccccttcacccacaccagcaaggaactacaagtcgtcggctaagccaagcaaacacaaaaaagcccgtaccagcccaatcgccttcgattggcccggtacgggcttttattactattcttttggttatggttcatgcaatggctcaccggctgtcttttccggttcttttgcttgctctttagtttggtcgattacgatgtcttcttctggcgccgcttgtgcttggtgcgcttgggccaaggtttggcgcaactcctcagtttgggcgtcgaagttgtcgttggtgaagtggttaccaaccttgcttgcctgatccttcaaggtgtcctttaggttatcaagcttgtcgctagcagcttcttggtaatcgccaaccgccccgtcaacgacgtccagcgctaacaaggagtactccgtcaggtaatccatcaggtccttaaaccgtccttggaactgttcgcgcagtgcttggcgcttttcttcgctcagtgccttataggcagccacggcggccacacttcccagtgccagccccgttaaaaactttcttgccattcgacgtcctcctactgattcttcttgcgcttaaagacccggctaacaacccccatcgccgctgcttgggccgcggacttcatgaagctgttgcggcgcttttcacgccggctcgctaagttttccaccagtgaacgggaggcttggttgacgtctgaaacgctctgtcccaggtcagcaatcgcctgaacggctggatcgacttgaaccgcctttttgttgatgtcctccaaaagggagttgctgttcttcaggattccgtttaattccccgctgagggtatccacatccttggtgagttgctcgacactagtgatggcatcccgaattgccccggccacctttacgaggaaccaggcgataaaaattaccaacacgacgagcgctagggccgcaattaagcccgcaagttgtccaacagtcatagtgaaacctcctttatttaatcttaaggatagcattattaggtatcgaccgcaaattgatttgccggcgtgccactgggttgttatgatagaaaacaataacgtttttatggataaaggaacaattttatggaactacttgcctccacctcgctgaccaaccaggccagccaaatcagccattacttctccacccttaattgggatgcgatcgtcaaaaatctgggtgatcggatcttgtccattctcctcgcctttgtcatctttggcgccatcctctgggttggaaaactaatcattgacgccgcctttcgccagaccaggcgcatccaggtgctgggcggaacgcaccgggcggctacctttcacgccttaaccctcaacatctttcgctacacctgttactttttcttactctacgccctcttatctttaatcggggttcccgtgggcactctgttggccggggccggaatcttctccattgccctggggcttggggcccaggggtttgtttccgacgtggttaacggttttttcatcctcttggaacaacagattgacgttggcgacgtggttcaaattggcaccaccaagggaaccgtggccgccattgggttacggaccacccaggttctctccacagacgggactctgacctacattcaaaaccgcaacatcaccatggtacaaaacttctcccgccacaatctgaccgccaacgtcgacatccaaatcacgccgacgaccccgctcgaccaggtggaggcgatcgttaaaaaggccggcccaagcctgctaaaggaggtcgacggcttaattaaagaacccgacgtcaccgggccaaccaccgatcaaatgggacggctggtcttccgggtggtcatcaccacccgttccggcacccagggtagcgcggcggccacctgcttagccacctacctaaaggatttaaatgacgctgaagttcctctaggcaacgaatgggggcacccgcatggccactaaaattaaaatgatcgtcactgacatggacggcacctttttaaacgacgcccacggttacgaccaccaactcttctctaaaacctacacccggatggtcaccgccaagatccccttggtgattgcctccggttcttcttaccaccgcttaacccgggagtttgctaaccaggtcgaccagctaacctttatctcccaaaacggggcggtcgtccacctggggcgccaactgctatcggttagccccctaaccaacgccctaatcaccgacgtcctagccctaatcaccgaccactttgcagcgggccaactagcacaactggtagtctccggggttaacgcctcttacattgaccagtcgatgtcccccactaatcgggcaatcgttaaaaccttttatgagaaggtgatcgccgtttcggacttgcggcaggtggcaaccctggtcgatgaccaattaacccgggtctcggtgacctttagcccgaccgttgactggcaagcggccaccgcctggctaaccgctcacttacccgccggcctcgccctggaaaactcgggctttcacacctcccaaatcggcctcgcttcggccactaaacagggcgccctactgaccctcaccgaccaagaacgggtagaggctgagcacgtggtgacctttggcgataacgaaaacgaccttggccttttgacaatgacgccccaatcctacgcgatgaaaaacgcggcgcccttcattcaaggacaagcggctaacgtcactacccacaccaataacgagagcggcgttttgcggaccattaacgccctgctcgaccaacgaattaaataaacgcaaaagagagtggaaaataaccttctcggcaggtcgtatgactaagctaggacgaacggttagtgcgaaacgcactgttcttcggcctgcttaggcactaggtctgcggttattgaccacgttttctgtctagcattcgggaatacaacaaggggctgggagaaaactgtgttttctcccagccccttgttaatttgagggatcgggaaaagctccgtttccccctacacctctgttatcgtttcaagcgcttatctaagccgacgttgaccaggtcgcggttgaagtagcgcacgatgaagtgctcgggcgtcgtttctaccgtggcaaaggtgccgcccaggtaatcgtactcgccgcggggttggctaattgagcccgggtttaacaacaagatcccgtccaccacctggcaagccagttggtgggtgtggccgtacgccgccaccgtagcgcccgcttccttggccgctagcttcaggttcaacaagctctggttgacgccatacaggtggccgtgggtcacgaagacgtgctcatcgcccactacttggtccaccacccgcgggaagggatcccaatcggtgttgcccaccaccacttgaaaaccggctaaggctgggtcatccggggataagtttgaatcgccgcagtgaaacatagcgtcaacttgatccgccaagccttccttaacccgctctaaaatagcggcgtcaccatggttatcgctaataaatagtgccttcattacttctcccaccattcttcaaagtctgccatcaacgcccgcagcgcccgtccccgatggctaatggcgtttttttgttcatccgttaggttccccatcgacgttgccaattcgtcaacgtaaaagagcgggtcgtagccaaagccgttcgtcccggttaattcgtgaagaatgtgaccattgacttggccgttggcgactagcttggcgccgtttggctttaggcccacgatcgtcgtgtggaaatgggcggtccgctcttcatccggtaccccagctaatttggccaggagcttttggttattagcggcgtcattatggtcgccggcatagcgcgccgagtgaatcccgggctcaccgtctaaggcgtcaaccatcaagcccgagtcgtcggcgaccaccggtaagttgagggctgaaacggctgcctgggccttttttagggcgttttcttcaaaactgtttccatcttcgacaattggaaatggggggaagtcggccaacgttttgacctcgatccccatgggtgcgagcatttcttgaaattcccgggccttgccggggttgttagttgcaacgacgagtgttaacacgttaatccccctcttcaatttgggcggttcctaagtcaaagtgccccgacaacaaccacttattcaccccggcccttaagtcagggaggttgcccgttgaatataggtggtaattggggtgggcgtggttacccattgcttggtgctgttccagccagaacttggccgtggccaccgtttccttagccgggtcgactaaggccaccgttggtccgaccgccttacttatttccggggccaaaaatgggaagtgggtgcagcccataatcagggtttttaccgggtgctctttaaaggtcattagctgttcactaaccacttcttgggccttcgccgtcccggtctggccgtgctcaacgatttcgaccattggctgggtggcctttgcaatgaccggggtacccggcgctagccgttcgatcgtagctgggtaggtaccggccgtggtggttgccgtggtggcgatcaccccaatcggtccctttttatcctgggccagggccgcccgggcgccgggctcaatgaccccaattacgggaattgggagcgccgcttgcagggccggcagtgcggccgccgtcgccgtattgcaggccacgaccatcatctttacgtcatgcttgagtaaaaaagcaccaatcgaaagcgccagttgacggacctccgcttgatccttggttccgtacgggaagtgaccttggtcgcccacgaagatgacctcttcgttgggtagtttttgctggataacccggacgactgaaaggccccccaagccagaatccatcactccaattgggcgattgtccattttatgttcaccctttctctttttcaacaggttgaaaccttattttcgcccaaatcaagctgctttgcaatcctcgcccctaaattttcattaagtccctcgcccggctgccgatttccggtataataaaatagatttccaaagaaagaagttattaaaatgacccaaacacgttacaaccacctcattaacagccaccggggtcttggagccgccaccctgcgtgacatcattatccccgcccttttaggaaccgaaacggaggggatcctctactggatcggtaaggacctggcccgtgaatacccggttgccaccgaagaagaactgatcgtcttaactaaccaactaggcatgggcgaattaagcctgaaaaaacggagcgccacccagcaaatttgggagctgggcggccccatcgttgacgagcgcttgaccctcgacaaggaaaccacctcctttgccctggaagccggctttttagcccaggaaattgaattccaactgggctcggttgccgaagccgaggtccaagaacgcggccgccacaccgccaccttcctggttcaaaacgacccccaagacacctccgattccgaacgcaccgaactcgttgaattcatccacccccaaatgccgactaccgaagaacccacgtccaagaagcgtaccggcttgtttgggcgaaagaaaaagaaataggaagtgcgacccccaccgttaaacgggccgtgggctaaaacggtgactaccttatccacagagattaaaaaaaagaagctggaattttccagcttctttttttagttgctcgccgcactcagccacttattaacggcgatcgataaacccgccgctagcgctagcatcaaaaaggaaccgctagccaggtggcaaacttcaaagagcataaagagggccattaaaggcgccgtttgcgaggaggtcaaaaaggcgaccgccccgaccacggcgaactgggcgagtgggatgcccggcacaataatggcgtacaccatccctagcaagacccccagtgaggcaccaattgaaatggacggggtcaagaccccaccgtagcccccaaaacgaatcgtcatcagggtgacgattggtttggccaccaaaccaaagaacagggccacgatggcgatacggctcggtgccgtcgtcgacattgccaactgggctaacccccgcccgttccccatgatttgggggtaaacggcggccactaacccggtcaccaggccgacgattggaaagagcaccaatagtttgacttggtggggtcgcttggcgctacaagccttgatcgcccgcccaaagaggtggcctaaccaccccattaacggggcgaccacgataacgtaggggagcaagcgtaacgaaagctcccggtcagagaccaggtagtaaggaacgtaacccttgaccaaagcaccaatcatggtggcgatcgaagacatggtcaacgagacggcgatcgcccgtggggtaattcgtttgtagagtagttccatgcaaaagaaggcgccggtaatcggggcgatgtagaccccggcgaagcccgctccggcagcggccgccaccaacaagcgtttatcgtcgtcttccagtgttaaagcggggtgttggttagcaaaatcttcccacttctgggcaaaggcggccccggcctcccgtggtgccaattcacgcccaattgagcccccggtcccaacgaagaagatctgggttaagacgtgggcaagggtgcggaaaaggggcatccgttgtccttccacggccttagctagctccaccggacggtagccctttttttgtaggaggtaccaagagaacccagctaggatcccccccgctattaccgacaagccccggtgaatagcgctggcgtccaggttcaccggcatccggttactctcttgaaagcccaaaaaaaggtgctcaacgtggtccaaaaagagacttagtaaggctgaactggtccccacaatcaccccgattaccaccgtggcaataataatcgggaggttcctttgtagttgttgtcggagttgcatccgtcattccccatttcactaaaattcacaccttcctagttaagcgcgcttagggaaaaattacaagtcctggtccaatttttaagaaaatcgaaaaggaggacgccaattagaaacaagcttctaaccagcgtcccccttatgactagaggtattgttttaaaagttgggcgacctgctctttgctgtggtagccgattaattggtcgactacctggccgtccttggtaatcattagggtgggaatactcatgatctgaaactgttcggccacgttggggttagcgtccacgtctagcttgtgaaaaccaacttgctcccccatttcctggtcgagggcttcaacaactggtgactgcatccggcacggtccacaccaggtcgcccaaaaatcaattagggccacgccggtcgccgtgtcttgttcaaaagtggcgtcgcttgtttcgtgtactgacatactccaacccccctttgtttaattacccctattttaccatttatttaatggtccggcgccccgattcacccgctaaaagtaggcgatcgttgccccgtcgcccccattgctagggctggcgtattcaaagttttttacccgggggttgctctggaggtactgttgggtccccttacgtagggccccggtccccttcccgtggatgatcgttaccgacggcaagttgtttaacaaggcgtggtcaataaaggacgccagttcactcatcgcctcttcgtaacggtgaccccgcaagtctaaccgggcactggtttgccgcgtttgaatcgtccgcaccgccattcgccggggctgagcgtgctttttctcggcttgcttagcctgcttagccgaaatcttttcgaggtcggcctcgtcaatggccatcttcaaaattcccagttggacctcccacttatgggcgccgcgcttgtttaacaagaccccttgctggccataggacttgacgttgacgtggtcccccaccttaagttggtgcttttgcttggcccgttgtaaaacgctgttgtgatttaagcgtgggttgtccttgtgtagggcgtttaaggccccctgggcgtcaattaattcattttccttaaccgtggcgccctgaatttctagttggcggaggtggtggataatctggttggccttctttttagcttgggaaacctcgtggttggcctccgaacgggcccgttccaagagcttatcgcgctgctcgttaaagcgatcgagtttggcgtctaactcctctttggtggccgcgttttccttaactaacgcctgaagccgttcgttttcctcccgggcccgcttgcgttgttcgaccaggtcaccgatcatcttgtttaagtcctggctgtcatcagagaccaacgatgaggcctcgtcaatgaccgcttgctcaatccctagccgcttggcgatcgcgatcccattggactgccctggcaccccaagtaagagccggtaggtcggctgaagggtttgctggtcaaattccattgaggcgttgattgtcttggctcggtcgtagccgtagaccttcagttccgggtagtgggtcgtcacgacgacttcgctacccgttgccccaatttggtcgaggattgccatcgccagggccgccccttccttagggtcggtcccggcccccagttcgtccaagagtaccagggagttagcggtgatttgttctaagatccgcttaacgttttccatgtggccagagaaggtcgacaggttttgttccaacgactgctcatccccaatgtcggcaaagacgttatcaaaaatggcgaccgtcgagttttcgttggccgggataaacatccccgactgggccattaactggattaagcccagggtctttaaggtgatcgtcttcccaccggtgttcggccccgtgatcacgattgcctggtagtccttacccagggcaatgtcgttggcaaccaccttctcctggtcgatcaaggggtgacgggccatccgtaagttgacctcaccctcctggtttaaaagcggtacgctcgccttcatcgccgccgccaacttggccttggcgttaatcaagtcgaggtggcctagcaactgggcattttgcgcgatgtcgttgcggtaggggcgcaccaggtctgataactccgctaggaccttacgtacctcttggcgttcctcaatttgggcttggcgcaagcggttatttaactccaccacgctccccggctcaatgtagagggtttgcccggacgctgattggtcgtggaccaccccgccaaactggttgcggtactgagccaagactgggattacgtagcggtcgtttctgatcgtgataatcgggtccgacagcttcttggcctgcttgccccgggtgtaacgctccagttcgtggcgaatatcaacttcggtttgggtgatcaactgacgaaccccatgtagcttagttgatgcctcatcggtcacccggccgtccggatccagtgagcgagcgaggcgccgggtaacctccggaatcgtcaccaatgacgtcgccaggttatcaatggtccgcaagcgaattttcttttcgactaggccctcaaaaaagttttgcaccgccatgctggtccgcaagacctgggtgatctgggccagttcggtcccgtttaagctggcttgcaccttcaagcgcttgagttgggggctaacgtcggctaactccggcaggggaattcccccgaccaaacgtaataggtcggccccatcctccgtttcttccacccaatggtgaatggtggtgtaatcggtttggggttcgagcttagccagttccgcccgtcccgtggccgaaacgataaactgggcgagctgccccttgacccggccgtactctaaggtttctaaaattttatggttcattgacaaatcgatcctccttaaatgacccaggagatgaccaccttggccatccccggggtttgattaatgatccactgggccaatcccgacgccgctagttggctttgccaccaatcaacggggaggagctggaagatgaacaaaaagacgaagatgattaaataccccaacaggcaatctagcgccccgccggcccagccgttaaccgtcccgaccaccggaacctggcggacccagttaaagcggtgcaacaaccagcgggagaaaaaggtgatcgcccaaaagatcagcataaagctgaccccactgtagaaaaactcgctggtgctcgtctttaacaggctcgtgaccgttgaattggtgctgtcggtgatcgacggtaagataccagccaacgcggcccccacaaaccgggcccccagccgggccatcaaccacgccaaaaaataagcgaccgtcgtaattaccaggccgatcagccccatccggcggccgtgaatccaacaacccattaaaatgatgatgataatggcggtaaggatcatgtgttccctcctaaattttcactgaatattttagcattttcaccccggatttgctatcgtagggattgcaacagaaaggggagcaacatgaacatcgtaattaacgttgatacaccgacctttgaacagatgaagtcaacctaccaggccccgggaaccctcccggccggggcgtcctttcacgccaagctaaagggggtcaccgtgaccggctacaccaagagccacaaggtgatgtttcagggcgcccttgccaaccaagaggccgcccgatggcaaccaaacgacgccccagccccctcgcgttcgacacctgccccggctggcttacccgccggttttgccacctggtcggtcttggggtccgatgaggtcggggtgggctcttactttggccccctcaccacggcggccgtctttgtcgccgccgaccaagtcgcttccctcacccagctgggcgtcgccgattccaaaaaactaaccgacccggaaatcattcgcttggccaaacagatcatggcaacttgcccggtcacctacctcaacttgatgcccgcggcctataacgcccgcatgaaaaagtataaccaggcccagttaaaggccctgtgccacaactacgttctcgctaagacgttagaacggttagccaccaagccgcaggccatcttgattgaccagttcgtcagtgaacggacctactttaattatttgcagggccaaccacagattgttagccaccacgtttattttcaaaccaagggggaacaagctcacgtggcggtggcagcggcctcgatcgtcgcccgctaccaatcgttgaaggcaatggataccctgtctgaacaagccggcatcaccctgccaattggggccggtcacgccgtcgacttaatcgccgccaagctaatccgcaagggcctcgacctcaaccagtttgccaaggtccacttcgctaacacccaaaaggcccgccagctggctcgccaataaaatagggaaagcttccgtcttgtttcggtggcccccacttaaactactgctcaaactagcacatccggatatacagcaagaggctgggggaaaacatggtttcctcccagcctcttataatattaggcgttaaaattgccatcgtcatcgataaaggtgttaagcacctcttggaccatttcccattcggcatcgttttcgatcggcaatagttctaactcgtcttcttctgaagtaggttcttcaaaggcaaaggcctgaatcccaacctcctcgtcgttttcttcgtccagcgggtagaggcagatgtaccacttgcccgtctccggtgattggaaacgcattgcctctttgtataattcttcgttgccggcttcatcaaccagggtgaagatttcgccgtcatcgcgtggcgtttgctcactcatgacaattcctcctatagcttggcgcacaacttaccgtggcgatccaagtaattctgtaagattaaggtggccgccaattcgtcgatcacctttttttgtttgcgccgggaaacgtcagcctcttcgactaacatccggtgggcttggaccgtggttaagcgctcatcttgatagtcgattggcaaaccaaaccgctcctccaagagctcaccgtaatggcgtgccgcttcaacccgtggtccctccgtgttattcatgttcttgggtaggccgagcacaaagccagcgacctgacgggatttaaccagttccgccacccgctctaagccaaagacctccgcttcctcatcaatggggatgatttccacggcttgggccgtccagcccaagggatcgctttccgccacccccaccgtcttggagccaacgtctaatcctaataagcgcattactgaacgtccccactgttcttcaggtaggaccgaacgagttcttcgataatttcatcgcgctcgtgctggcgaatcaagttccgggcgttatttagccgcggaatgtaggcaggatcaccagacaagaggtaacccacgatctggttaatcgggttgtagcccttttcttcaagggcatcatagaccgtcttaagggtctctttgacgtttttttcgtgcaacttatcaaagtcaaaaaacatcgtttcatcagttgccatttcagtcacctccatcaaatgtaccattgctaattgtactatatccccaccaaaagtacaatttagccccccggaaatggggccaaacaaaaacccctaccagcttgcgcaagccggtgaggggttttatttcgtaatggtgccaggaaattccccgcggacttagtgtctaaatccagtctaccgaggaggaaaatgtcgactttcccttaatcattcatgaattggctagccagcttgagagcttcgctaatcccggctgggttctttccgccggcctgggccagggttgggcgaccgcccccgcccccgttaatggccggggcaattgccttgatcaagtcaccagccttgaccgtcttggccaggccatccttgactgctaccaagaggttggccttgtcaccagcggccgtggctaagaccaagacatcggagtaatccttttggcgccaatcgtcagccatttgacgcagttggtccattccggccaccttaacttcggcggcaatcaaggttcccttcgccgtttcttccgcctggttgaagacgtcgccggcttgttgggcggctaacttagcttgcagggcctcgttttgcttcgtggcttccttgagctggtcttgcaactcactaacccggtgggcgacttccttaacttgagccaccttcaggtcggcggcgatgtggtctaggctgtcgacccgctcttgcatgaaggcaaaggcgtcactggacgtcacggcttcgatccgccggaccccggcgccgaccccaccttcggaaacaatcttgaagaggccgatttcgttggtgtttttgacgtggtccccaccacagaattcggtgttgaaatcaccaattttaacgacgcgtaccttgtcaccgtacttgtcggagaagagggcgattgcccccatttccttagcggaatcaatgtcggtttcgaccgtcgtgaccggaatttccttccagatctgttcgttgaccatgtcttcaaccttcttaaggtcctctttagtaacctgaccaaagtggttgaagtcaaagcgtaggtagtgggcctccactaaggacccggcttgttgggtgtggccgcccaagacgttgcgtaaggcttggtccagcaagtgggtggcggtgtggttcttttcaatcttgaggtggcgggcccggtccaccactaacttgtagcgggcgcccttcttaattggggcggttaactctaaggtgtggaggttttgttggtgtggggcgtgttggacgtctttaaccgtggcaaccaccttgccgtagttatcgatgacctgaccggtgtcagctacttggccccccatttcggcgtagaacggggtctggtcgaagatgacgtcgacgtgttgacccggttccgcttggtcagcttgcttaccgtcggcggccaacccgattaccttggcgttatcaaccaccaggtcggtgtagcccacgtacttactttcgtccgtgaagttggtccacaggtcgctttgcacccccatcccgttgtccatgtcacgggcgttgcgggcgcggttttgctgttcggtcatcgccgcttcaaagccctgttcgtcaacggtcaagccctcgtcggctgcgtattcacgggtcagctcaaccgggaagccgtaggtatcgtaaagcttgaaggccgttttcccgtcgatttgcttgccatcagtttgcttagcctcatcgatcacgctgtttaacaggctcagccccccgtttaaagtggcggagaagcggtcttcttcagaggagatcactgaggcgatgtagtcggcgttttctaagacgtctgggtagtagtccttcatgatttcgccaacggtgggtaccatcttagctaggaacggttcgtcaatccctaacttcttgccggccaccaccgaacgccgtaagagccggcgaatcacgtagccacgcccgacgttggatggcagggccccgtcgccaatcgcaaaggtgatcgaacggatgtggtcggcgatgatcttgaactgaacgtcatcggcggcgttttggccatactgcttgtcggcagagaagccttctacctgcttgatcagcggcatgaagaggtcggtttcaaagttggtcttggcgttttcaaagattgaaacgacccgttccagccccatcccggtatcgatgttcttgttcggtaacggttcgtaagtgtcttctggggtgtggttaaactgggagaagacgatgttccagatttccaggtagcgttcgttttcgccccccggataggattccggatcgtcttccggtaagttgttcatttcctggccgcggtcgtaaaaaacttccgtgtccggaccggacggcccctggccaatgtcccagaagttatcctggtcggctaagaggtggtcttctttgaccccggcgtccagccagaattggtgggcgtcgttatccttcgggtagtaagtgatgtagaggcgttccgggtcaaagccaaaccattcgtcactggttaacagttcccaggcccaggtgatggcttcctttttgaagtagtcaccaaccgagaagttccccatcatttcaaacatggtgtggtggcgggccgttttccccacgttttcaatgtcgttggtccggatactcttttgcgaagaggtcatccgcgggttgtccggaaccaccttaccatcgaagtagttcttcattgttgccaccccggagttgatccagagcagggtcgggtcgttaaccggcactagggagcgtgacggcatctcggtgtgtccgtgttgaacaaagaagtctaagtacatccgccgaatctgggcggagttcagttttttcagttctttcattgcctttcctttctaaaacaaaaaatccacccctgctagacagagacgccggtcgacgcggtaccactctgcttgcaacgatggattcgtttgccacttttaatcccccgtgggggttgatcactaaattatcccctggggagcaacctggtttggttcgtcgtgctttgcagccaccagcacgtttctaaaagttcccccaaccggtcatgtcccagatgtgtttcattataaccaaggggcggggcaaaatcaacgcccattctgttgacgagcccgctccgcccggtgttgtttttgccgagcccgcttcgccttgcgcatttcgtggcgctgggcctgcttaaccttttggcgctcgtcttctttaatccgctgcttgatgcggcgcttgtagcccggcttgacctttttcttggccttcttgacaaagcccttaacggtcgggtctaaggccgccttcttacggcggtgggccttgcggcggttccggtcgtaagtcgtgacgatccggccgtttttcaagtcctttggaataaaggtgatgccccgttcctctaacttttcaatcaggacgtcttcggcgggcgcgtacagggtgatggcggtcccggccatgttcgcccgacccgtccggccgacccggtgaacgaagtattccaggtcacttggaatgtcatcgtttaagactaaggaaaccccctccaggtcaatcccccgggcggctaagtccgtcgccacgatgtattggtagtccatgtcccggatttggcgcatcgtccgcttgcgggcccgtggttccagtcccccgtgaatcagggcgacctttaagccccgttcttgcaagtagttagccagttctgtcgcccggtcacgggtgttggcaaagaccagggccaagtacgggtcccctagggtcaacaggcggtagaccaggtcgtttttgtcgcgccccttggtcgacatcaaccagttttccacgttggggttgatgaccgtttcggtgggaatttcttcaatcaccgggttttccaagtacttcttcaaaaatggccgtagcccttggggaatcgtggccgaaaagaccatcatctggagcttttcggggaagcgggcggcgatttggtcaaccgtttctaaaaagcccatgtccaaggtcatatcggcttcgtcgatcacgaactggctagccgtgtggatatctaaggcctgggagttaatcaggtctaagattcgccccggcgtcccaatcaccagttggggttggcgccggttcaattgttcgacttggtgctccttgtcggtcccaccgacgtagttgtgaatcgtcaacggggtggtcgcaaagcggtttagttgcttggcggcgttataaatttggtaggctaattcccgcgacggggtggtgataacggcttggaccgtctggttgttgggggctagttggctaaagatcggcaacaaaaaggcatgggtcttcccactcccggttcgcgattggcccaccacgctcttaccgttgaggatcaacgggatcacccgggcttgaacggcggttggtcgttcaaagtgaaggtcctttagagccggcgttaaaaagtcggccaagtgaaggtccgcaaaagattcaatcattaaagttctccttttagaaactgggtcgttaactcatccagttcctgcataatttgtttcatttctgcttcgtcattggcccgggccccggaggcgagcgggtggccccctccgtggtggcgcttggccaattcattaatcaccggccccttggagcgcaggcgcacccggaaaccgccatcctcttgttggacgtagattgcccaggccacgacgtctttgatccgtcctggcagggaaacgacggccgaggtgccggcttcagtcagcccaaattggttgaggacttcatcggttaataagacgctccccgccccgctgtcggtaatcgttaagtgttcgtaaacgtaagcggacaaccgggccagggggagcgaaatttcgttttcgcgctgggaaatggcggcggcgtccgcgccggcggccattaaggctccggccaccagcatcgtcttgggcgtcgtggccgggtacaaaaagcgtcccgtgtcgccaatgatcccggcgtacagagccgttgccgcctccttggtcatcgttagttccttagcaaagtgttggtaaaaaccgtaaatcagctcggaacaagaactcgcctggtcatcgacccacatgaggtcaccgtagggctcgtcgttagggtggtgatcaattttaatcaactcatcgccgttattaaagcgccggtcgtcaatccgcggggcgttggccgtgtcggtaacaatcaccagggcgccatcgtattcgctactgtcgacgtcgtccatctggccgatccagttaaaaccggggatttccttacccacgactgccacttccttgtagggaaaagacgcccgtaaaatcgacgctaggcccacctgtgaaccaatcgcatctggatccgggcgttggtgccggtggataatgatccggttgtactttttaatttgttcaaagatcgcatctaagtctgccatcgtaatcttcctttcgtccgcttggggtaaccggttcttagtataccagtttttgacggcgaaccaaaaactcaccgcccgactttcccctcttctcggccctaacttcattcgccaagaacgcgaatgggccccagccgtccggaaatcccgaaccaagctggagcccaatcccgtttttagcgcggggccaccgaattttaaattgttctgctggcctgcgtactacttttcggcttgttccgctggcttttcgtcgtcagcgtcggttgcagccgaagcaggcgcttgttcttcttcagcctgagcagccgcttccttgttggccgaagctgattcaactggtgcttcagtcacggtcgttgcagcggccggagctggcgttgcccggttgaccttggcaacggcggacaggtcgaaagttaagtaaatcccttcgcagtcaatcgttaccgtttgttcggccgtattaacttcgtggaccatcccgtgtaagcgaccaatcgtcaccacggcatcacccggcttcaattggttcaccattgcttggtgttcttttcgttggcgctgttgaggccggatcatgaagaagtacatgaaggcgatcatcagcacgatcaaaataatgcttgacatgttagcgttcacaagaattcatcccttctggtgttaatcttagtaatattttaactataccaaaaaccagcttaaataccagttaatttaacatttcccggtgttttttcgcaaagtaagccgtccagttcttcacgttagcctcggtcaacaggcgcgttgctaagccgacgtggcgctcggttaagtagggccaggcttgcttgggtaaaccatgcggcgccccttcttcgaccggcatgtcgctgaggtcttcttgcaggtaacggtggtggcgcgccaaagtcagcggtaaatcggaaatgatcaagtggacccccgcttcaatcgccgcctgaatccggaagggcgttgccgcttcaaccatcaccaagccgttgggtggtaacaagtcagtggtcatctccaaactccgttgccactcctcgtcttcgagtggttgctcaaagccgcccaggtaaaagttggtaatgttttgctcgaccaagtaggcaatgctctcctggcgggcggcctttagccccgccccctgcacgacgccccacccggttggcgtttgagcgccccaggcggcgttcaccgccacggagcgcacgatgtcgtcaaccggggcgtagtggtcaggcgcctggcttaacgggagggccaccgaagcgtgggctgcctttaaccactcctcgtattcggcaccgttaacggttttcttggcgcccccatgggggagttggtagtggacgccgacccgttcgctgtttttcttcaccttcgttaggggctgaccgaacccggggagggcaacggtgaggccttcccacttgagccaagcaccgaggccgccaacctcccccagggtggccgcgccgggggcgtccatggccggtgctagcggtaaggcgacgatccggaccccacagtgggaaaataactccccggcggttagcggatcggtggtcaagagggggagctttaataccggcatcgggaccgttagggggtagctagtcatggtcatgttaattttcctcctggtcaaagggtatcttgaggtgttcgtaggccacaggggtcaccacccgcccccgcggggtacgcatcaaaaagccgatctgaaggaggtagggttcgtacatctcttcgatcgtgttgacctcttcgccaatgttggcggcaatcgtccggatccccaccgggccaccgtggtagtgctcgatcatcgtggtgaggagcttgcggtcaatctcatcaagcccctggtcatcaacggccaataagtctagggcccggtcaaccgtggccgggtcaattgccgcctgaccgcccacctgggcaaagtcacgcacccgctttaagagccggttggcaattcggggcgtgcccctggagcgtagggctagttcgtgggccccgtcttcttgaatcttagtgttgaagatggtcgccgaacggtcaatgatttggctgagctccgtagtagtgtaataatccatccgggccacgatcccaaaccggtcccgtaaaggcgccgctagtagcccggcccgggtggtagccccaatcagggtgaagggcggcagcgggaagtggaccgggtgggccgtgggaccctcgccaaccacgatgtcgatgtaaaagtcctccatcgccgagtagagcatttcttcgaccaccttgggtaggcggtggatttcatcgatgaacaagacgtcccccggtttgaggtcgtttaagagtgccaccaggtcacccggcttttcaatcgctggccccgaggtggttttgatggccacttgcatttcgttggcgatcaccattgctagggtcgtcttccctaaccccggcggcccgtacaagaggacgtggtctaaggcctccccgcgtgacttagccgcctgaatgtagaccgctagttcatgtttgatccgcgcttggccgatgtaggtcgccagggtttgggggcgcaggctaacctcgtctcgcccctcctggtcatcagtgacctcatttgaaagaacgtcatcaaagtcttgttccatgaaaacctccttatctgctcaacaacttcaggccctggctgaggtagtcgttggtggacagctcgccttgcaagccttccaattgcttttgaacccgttcgacttgcttggtcgtgtaccctagcgactccagggctgccaaggcgtcttggagtgccgcggacggacccagtggccctgggaccgtgaagtcgagttggacctcgtcttgaaccgccacgaccttgtcctttaactcaataatgatccgcgaggccgtcttcttaccaatccccgggaacttgctcaggtacttatcgtcgccgttttgaatcgcgtcgattagcccctggtggtcgggagtggctaagattgccagggcactcttcggcccaatcccggagaccccaattagctgggtgaacaggcgcttttcggcctgggttgcgaacccaaagagggtaatggcgtcttctttgaccgcttggtaaataaagacctggacggcctgttgatcgtcttcttggtaggcgtaggggttggccaccgccacccggtagccgaccccgttgacgtcaaccacgataaaatcggggctgaccattgtaattaaaccggttaaatattcaaacatccgtgttccttacctttcgtcttcgttcccctattttagcacacctgttcgccttagtcctcgtggtcgtcaaagtcgtcggcaaagggttggtgggactcttggatccgcttaaagagcttctccaagtcggtggtggtaaagtgaatcgttaccggccggccgtggggacagttaaaggggttctcacactggggcaggcgggccaacagtgccttggcctggcgttcgtccaaacggtggttggccttaatcgcccgcttgcaagacatcatgatcgccgccttggcccggaagtccttgacgctcagcttgccactggccaaaacccaatcgatcatctcgcgggcggtatcctcttcttggcccgccacaaaccaggtcgggtggctagcgagcataaaactgttttgcccaaacggctctagttttaggccgcaggcggctaacactgcttggtgttgttggatctttaaggcgtcggctaaggagtagtttaaaaccaagggggtcaaaaagttttgctggtcggcagagaccttgccaatctcttcacggtagtattcgtaattgatccgctcctgggcggcgtgttggtcaacaatgtacagcccatctgaggcttgggccaacaggtaggtcccgtggagctgccccaggtagataaggtccgggaaacgttcgctcgcgacgtcgccccggtcgtcgatgtctaagctcacctgttccaccgccggttgtgcctggctaaccttcgcgtccgcctgggcgccaaagggggtcgccacttcttcattttggtagcgccggtcaaaggcttgcaccgccgggctagctaattcgctgcggcgactaataatcaccggttccccactggtcgggctgggctgccaggccggcggctcgtcgctggcccgttcgctgacccggggggcggcgcttctcggggcgtgaacggtctgctccctggttaaaagttcgtcggcccggtcaccaacgtcgggaatcaggttctgttggtcgatggcctggctgacgacccgctcaagtaagtccactaactggggttccatgctcaagcgaacctcccgtttagccgggtggacgttgacatccacgagcaccggatcgaggtcaatgttgatcaccgctagcgggtagcggcccaccattaacttggagcggtaaccggccaccagggccttggtcagctggaagttccgaacgtagcggtggttaatcatgatcgtcatgtactggcgcccggcccgggttaactcgggcaacgagaccaaaccagataccttgaagttcgggtcttctcctttaacctcaaccatcttacgcccggcttggaccccgtaaatagcggcgacgacctgttttaaattaccgttccctgccgagcgaaagacctccttgccgtcatgggtcaaggaaaaggccacggtggggttggccagggcgaggcggttaacgatgtccacaatccgggctaactcggtgtggggcgacttcaagtacttgaggcgggccggggtgttgtaaaagaggtcgctaaccaagatgtcggtccccggtcgggcactggcctggccatgggcgaggatctcgccccccttaatgtggatctggctgcccgccgccccgccagtcgccgtggttaacaagacatccgctaccgaagcaatgctgggcagggcttcgccgcgaaaacccatcgtcgtcaccttaaagaggtcgcctttatcggcgatcttactggtggcgtggcgcaaaaaggcccgggccacgtcgtctgcttcgatcccctggccatcgtcaatcacccgcacgctcttgagccctgcttcttcaacgataatgtcgattcggtggctgttagcgtccagggaattttccgccaattccttcacgattgaggcggggcgttcaatcacctcgccggccgcaatctggtcggctaagacgctgtctaattcatggatcttgcccatcgtgttcccttccttgttactttagattctgttgccacttgtaaacctggttcatcacgtccatcggcgtcatgctcatcaggtccaagttcttaacttgccgggcaagtttatcggccttaccgtcctttttttcgaccggggccgtggcaaacaattcgagttgaccgctactctcctcgactaacggggtcgtttgctctttgaccggcgtttgctcctttgctggcgtcggttctatcaccggtgctggtggttcgacaccccgcgaaggaaccgccgccgtttcttgcccctccaggctggttaggatttggttggcccgggttaagagcggcgtcggcatccccgctaacttagcgacgtggatcccgtaggacttatcagctggccccggggttaccttatgcaagaagaccaactcgccgttttcttcggtcgccccgacgtgaacgttttgcaggtggtccagttcgccttcaagggcggttaattcgtggtagtgggttgaaaacagggtcttggcgccaaccctgttgtgcacaaactcaataatcgcctgggctaaggccatcccgtcgtaagtagcggtaccgcggccaatttcgtcaaacaaaatcaggctgtcggcggtagcgttttgcagggcgttgttggcttccatcatttccaccatgaaggtcgattcaccggataccaagtcatcggcggccccaatccgggtgaagatttggtcaaaaatcggcagctgggcccgcttggctggcacgaagcaccccatctgcgccatcaccgccgtcagggctagttggcgcatgtaggttgacttcccagacatgttcggcccggtaatcaacaggatgctggtatcgccacccatcaagacgtcgttaggcacgtactcctggtggcccatgaacttttccacgaccgggtggcgcccgtcttcaatctgcagctggtgatcgtgattcaggcttggccgcacaaagtggtagtcctcggccaccttagcgaaggcctgaatgacgtctagggccgccaggttcgccgccagcttttgcaggcggtcaatctgttctttgacggcttctcgaaccttcacgaagagctcgtattccagagcggttgacttgtcctgcgcccctaaaatcaggctttccttttcctttagttccggggtggcaaagcgttccgcattcaccagggtttgctttctttcgtagcggtcagcgggtaacttgtcgatattggccttggtgacctcaatgtagtagccaaagacgtggttgtagccaatctttaagttattgatcccggtcgcccggcgttcttgttcttgcaggtcggcaatccactgcttgccgttttgcatggcgccccggtattcatcgagttggtggttatagccatccctaataacgccaccatccgtgaccgagatcggtggttccggggcgattgcccggtcaatcagacccgctacgtcctcaagggggtctaaggcctgttccaggtcatcaaaggccggcacgtctaacgtctgcaaaatgtatttaatcttaggtacctgctccagggaggtctttaactggatcaaatcacgcccgttcaccgacccgtaggcgacccgaccggccaagcgctccaggtcgtacaccttgatcaattcttcttgcaggttttgacgctcaaagtagtgatcgagtagctcctggacccggtcgtagcgccgctcaatctttgcctggtccaacagcggtcggtctaaccactgcttcaacagtcgtgaccccatcgccgtctcggtctcatcgaggagccaggccagcgtcccctgccgcttgcccgagcgcaagttggtggtcaactccaggttcaccttggaacggtggtcaatcttcataaaggaagagagttggtaggccaccgcccgttgtaggtgggccagggagcgtttttgcgtcgttaacaggtaggaaaccaataaggcgaccacgtctcgttgcccggcgtccgtgaggtcttggctcaagtaggccacctcggcttggttcaccacttgcccttgcgttgaacgtaaaatgttgcgcttggtcagttggtcaagcaggctcgctgaaacttccggttcggtgaccacctcccgcgtttgcaggttaactaattcgttaatggcggcggcctcgtttgacaccttagtgacctttaactccccggttgacaggtcggcgtacgccaggttgtagccgccttgctcttgtttgagcgccgttaggtagttattttgccgggcggcgtcccccgctaggtccatcgtcgtccccggggttactagccgggtaacttcccgcttaaccatccccttggtcgtcttggggtcctccatttgctcgcaaatcgctaccttgtaacccttatcgattaggatatcgacgtagttatcgaccgcccggtggggtaccccacacatcgggatcgagttatccttgctcttgctacgtgacgttagggtcagttccagtaactgggcccccttaacggcatcctcgttaaacatctcgtaaaagtcgcccaagcggtaaaacaaaaaagcatccgggtactgatccttgacccgttggtactgttccatcatcggcgtttgtttacttgccacactgccacccctttttaattactgctttcattctatcattttctcttagaagagaacaaaagagccgctagcaatgctgcggctcccctatctctacttggcataatcgacggcccgggtttcccgaattaccgtcaccttaatgtgccctgggtattcaagttgcttttcaatctcttgcttgaggtcgtgggccaaggtgaccgcttgcttatcggaaaccttggttggtttgacaatcacgcgaatctcgcggccagcctggatagcgtacgaatgatcaacaccgctattttggttggccaactcctctagcttcttgagtcgttgaatatattgttccaacgactcactacgggcaccaggacgggccccggaaacggcatcggcagcctgaaccaggacggcaatgatcgaggttggcgccacgtcgccgtggtgagatgcgatcgtattaataacgaccttgttctccttgtacttgcgggttagttccacccctagttcaacgtgggaaccatcaacttcgtggtcgatggccttaccaatgtcgtgcaggaggccggcccgcttagcgagggtcacgtcttcaccgagctcagcggccatgatccccgctaacttggcgacttcaattgagtgctgtaagacgttttgaccgtaactggtccggtacttcattcgcccaaccgtcttaatcaggtccgggtgcatggtgtgcaggcctaggtcaaagaccgtttgctccccgacttcacgcagctgggtatccatgtccttgcgggcccgttcaaccgcctcctcaatccgggccgggtgaatccggccgtcttggatcaagcgctccagggccatcttggcaatctcacgccgtaccgggtcaaacccggataagacgactgcttccggcgtgtcatcgatgatcaggtcgatcccggtcagggtttctaaggtccggatgttacggccctcgcgcccaatgatccgccccttcatgtcgtcattggggagggttactacggtcacggtggtttcttgaaccatatccgcggctgagcgttgaattgcggccacgattaagtccttggcgttcttttccgccgttaattcggcttcttgttcgctttgccgaatcatcgtttcccgttcactttgcaactcttcttttagttgcgaaaggagccgttttttggcctcttcgtgtgatagctgggcgaccttttcgagctcggcttggcgctgctcgactaaatccgctgcctgttgttgacgcttttgaatctgctccgtcttttgatcgagcttccgttcccgggcgctgatcgtagtttcgcggttctccagactggtgtccttgcggtcaagggttgcttcgcgttggagcaagcgctcttcttgtttttggacctcactacgacgatccttgagttcttgttccacgacttcccggtagcgatggctttcttctcgggcctctaaaatggcctcctttttcgccgtcgccgcctccttttgggcagttgcaataatccccgcggcgttttccttcgcctgggttaatcgttgttcgaaaacgattttcctacccacgtaaccggcaattagaccgacaacaatagcgacagcggcgattaataagctgattgcattcatcagttcaccttcctatcaactattgacttgttggttcaaaagtttgattaattttaagtaatgcaaaaaaaattcacatacaaaataattttaagcgtcccgccatggggtgtcaatcaacttcgctgagatttggaaagaaaaggaagtgcgaaccaacctcctcgacaggccgttgggctaagctaggatgaaggttgttgcggcacgcagcgttcttcagccgtacttagacactaggcctgtggttggggagcacgttatctgtgtaatagttaaaaaacaaattcaacggcctgcttaggtgacatggctgacctcgttttctacctaccattacggaatacagcaaggggctaggagaaaagacggttttctcctagccccttgtccattatttgtcactcgacgcttctttaatcgtttcttgttgcggttcgccttccttggcggccggcgcttcgtccggttccatcccgtaggccacccgcaccttgttcatcagctcgttcatggcgtcttcgtggtccgcaaaccactgcttggcgttttcacgcccttggccaatccgttcgttaccataagaataccaggccccggacttgttgaccaggtccttttcgacggccatatcgagcagttcccccgtcttggagatcccttccccatacatgatgtctacttcggccttgcggaacggcggtgccaccttgttcttcacgaccttaatcttggcccggttcccgatcacatcggtcccgttcttcagttgttcaccgcgccggatttccatccgaatggttgagtagaacttcagggcccgaccaccaggggtggtttccgggttcccaaacatcacccccaccttttcccggatttggttgatgaagatggcgatcgtcttggtcttgttgatttccccggaaagcttccgcagggcttgggacatcaagcgggcctgtaaccccacgtgggtgtcccccatttccccttcgatttcagcccggggaaccagggcagccacggagtcaaccaccacgatgtcgacggctcccgaagcgatcagggcgtcggcaatttccaacccctgttcaccggtgtctggttgggacaagagcaagtcgttaatttgaacccccagggcggtagcgtactggggatcgagggcgttttcggcgtcgatgtaggcggccgtccccccacggcgttgcacttcagcgacggcgtggagagcgacggtcgtcttcccggaactttccggaccgtacatttcaatgattcggccccgtgggtatccccctacaccgagggcttcgtcaatggctaaggagccactggaaatggttgcaatcttggtgtcggcggcgtcacccatccgcatgatcgaacccttcccaaagttcttttcaatcttacgcagggcgttatctaaggctgcttttcgttgatctgccaacttgtgttcctcctttgatccgtaggtgtctttaattattctatcaggttctttgcaaaagacaagcaaaaagtcgaacaggggttcggaaagttgccgtagggcgttgtaggccaggcgcatcccctcctggacgctttgctggcggacgaactggcgtgtttgccccggcaagcggaggaggtggctttcgacggggcgtcccttgatcgccaggccgagccatacggtgccggccgggtggccctctaagtcatccggtccggccaccccagtgaaggaaagacccacgtcaacgcccattttttgttggcagccactcgccattgcctccgccgtttgcttcgaaaccaccccgtattggcgcaccgtttcaaccggaacgccgagcagttgttccttggccgaggccgcgtaggtgacaaaaccgccgtcaaagacctcgctggcccccgccaccgagcacagggtggcttgaaaaaggcccccggttagactttcggccccggtaatcttaagccccttttcctttaagagggccaccagctggctggccatgctgaccccggcgccccggccaatgtagtagtccgcctcttgtcgggcgatcttggcgatggcctgctccaataaggaagtcgcttcttctttagccacgtcatggagtgtcacccggacctgaatttcatcaggctggacgtaagaggtcaccactaggcgttcgtcaagccctagcgaggccagctcttgcattagcagcgactccgggcggccaacgaagtgcaaaagggcggagtaagtctggtggccctttccgaagtccgcctttaggtgcggcaagagggattggtcaaccattggcttaaattcgtgcggtggccccggtaaaacgacgtaggtatgggcgccgtcttttaaatagaccccgagggcgaggccagtagggttagacagcggggtcccccccgctaagtagtaggcctggcggatgttttccgggctcacggtcgcggaaatcgaccgggcctccagttgggccttgatctgttgccagtagtcttcatcgagccgtagttggcgccccaagtagtcccccaccgccgccatcgtccggtcgtcttcggtcgggcctagtccgccacaaataaagatcagattggcacgttccttggcggttgcaagggcctgcttgatgcgggcggggtcatcatcaacgttggtttgccacggggcctcaattgccaactggcgcaactggtcggcgaggtagcgggcgttggtgttggtgatttgacccaaaatgatttcggttccgacagaaatgatttccgcttgcatggcggttcccccttaatcaataaatacggcaaaatggcaaaaagggacgaaccaaattggtctcgtccccgaaaaattatttgaacccgtcggcaaagacgccgcggcccttcacgaagtaatccaccccggagtacaccgtgaagaataagcagatgtagagcatgatttggccgaagggaattccccacatggcaaagatcacgttgtttaataacaagaagatgatcgcgataaactgcgtcgtcgtcttgatcttacccggcatcttggcggctaggacctgaccgttttgttccacgatcaataagcgtaagccggtcacggctagttcacgccagataataatcgtcgtgacccaggccggtaccaccccggaccccgtcatgacgatgaaggccgtcatgaccaagagcttatcggccagcgggtcggtaaacttaccgaagttcgtaaccaggtgctggcggcgggcgatttgaccatcgaggttatcggtgatcgtcgcggcgataaacaggatcgccgcaatcaattggctcaccgggatggtggccccccaaaaggtgacggcaccccagtggaagggaatcaccatcaggatcaggaaaaacgggattacaattaagcggaccacggtcagcttatttggtaaattcattgcaaattaactcctttagcgcgtcgatgaagattgggtggaagtgttagtcgtcgccgtcgttgacgttgagttcgtcgtggttgcgacactggaactagccgcactagttgaagttgaactagcactggaactagcggtcgtcgtcgccccaaacttaatcgtcaccgtccgggtgttggcgtacttaccgctgtcagtcaggtctagggtttggtcgccgatcttaaccgtcgttgcgcttgcgttccccagggtcaagaccacggtttgggcacccttgggcagggaaaccgttgacgtcgaattagccgtcagggtcttagaaagtttgctagtcccatcaaccgtcacgctagtccaggcttgaccgctggccttaatcgtcatgtcggtatccttggtcagactactggtagttgaaagggtgacggaagaagtcgtccggttcgcagcggtgaattccagcttagcagccttgctagacgagctggaagacttggaactggagctagaggaggacgactttttcgacgattccccggaaaccgacacggagctggaatcgatcttggtagcggcgtcctggcggttacgaacgatcgccgttgcccaaatcgcccccaaaataattaccaccaccaccgcaatgatcacggttggtaagtaacggcgcgcccggtcaacccggtcaacggttggttggcggttgccagtccgggtttccaccgcttgggcaaggtggttagaatactcggcggtcttggtttgcggcagatcgtcgtcgtaatcctttaaaagggtattaccgtctaaccccaccgtgtcagcgtattgtttaacaaaggcccggacgtaaaaatcccccggtaattcgtcaaacttttcgtcttcaatggcgatcaggtagcgcttttgaattttggtggcttgttgcaagtcatcaagcgttaagccctttttctcccgtgcctcccgcagctttttgccgacgttgactctttcttcgttttcactcattacctaattcctcattcttttttacagtattaacagttaccaagtatagcatactctcttgaaattgctgggcttgcccgtaaatcataataaagtttaaacttcttgcttcccctccggaaggacgaaaaaggcactcagtcgttgcgggacaattaactgggcgactgcgttttgcaggtcagcgaaggtaattgactccagcgacgccaattcatcgaagatcgtggcctgatcaaagaggtggccggaaaagcggttggcaatctgttctggtgagtccaggcaagcgactaggcggcccacttgtccccgcttaatcgcttcaaactggtcccttgcagcgtcgagttcgctgggcgcccgccttaaaatgtcgataatcgcatcggcaaaggcctcgggccggttggtttcgctcgcaaaggtggcaaagtggaacccacgttcaatctccagcccgaaaccaaaggaatcgtccaagacctcttcgttgtacatccgcaggtagttttccgacgtgtcgtcaaatagcagttccagcgccatcccgatcgcttgaacgaaacggaggcgctcctggccactttcaaagtcgctaatcccccgcaggccaatcatcgccttgggccgggccactggcatctctaaggtcgcaaagggaacgacgtcgtttgcctgggggtccaccggggcaaaggtgtggactggtaggggcgccgccggccagttggccagggtctggttagcttgtacccattcaactacccggtccgggtccaagttaccgaccacaaacaggttcatgttaccgggttggtaaaaggtccggtggatctggtacagcaactccggggtaatcttggcaatcgaatcctcactcccggcgatgtcgattttaaccgggtcctccgggtacagattccccagggtccccatgtacagccggttatccggattgtcagcgtacatccgaatttcctggccgatgatccccttttccttgtccaccgtttgttcggtgaagtaggggtcaaacacaaagtccagcaaaacgtccaggctctcatgaaggtgcgcggtggtcgaaaagaggtagctggtctgggtaaaactggtaaaggcgttggcgtcggcccccagcgctccgaagaggtcaaaggcatcgtgatcggccttttcaaacagcttgtgttctaagaagtgggccaccccgttgggtaccgtttgttgctgaccatcgataacaaaggtgttatcaaccgaaccgaaatcggtcgttaagatcgcgtaggttttgtggtaatccggcattggcaacaggttaatcttcaagccgttagcgagggtcgttttatagagttcccgcccgtaagcagggtaatcaagcttctccatcggtttctcctcccttcccgtcgagtaaaaagacggcctctagtgtcatctgggccgctaagttggccacttcctctttggtaacagcccggagcccctctgccaccttttgcgacggctcgaggcccattaaggcggtgatcaagcgagcttgggccaagacgttggggttatctagccccgtcacgtattggttcaccaatccctccttgacccgctggaactgggcgtcgttaaacttacccgccgccaggtcggccacctgttgttcgatcagcgcccgcgcctgcgtttgatcggccgggttaatcccggtttcaaccaaaatctcgccgctaaaggcccgcagcgaactggtggcgtaataagccaagctagccttctcccgcacgttggtaaacagcagtgagtacggggtgcccccgagcaggccgtttaaaacgattgccgttaggtagttgtcctgccggtagtaagcgggcaggtggtaggccaggtccaacttagcctgggccagtggctgaacctcagttgcaaaggctggtgtttggcgggccgcttggtggtacaagaggctttggtgcaggggagattggcgcggggaaaagtccaacgcacgcatggcctgacacacggccgcttcgtcaacgtcccccaccaccacgatgtcaatcttgtcgtgggccagcatttcttggtaggcctggtaggtttgctgactagttatattttggacctccgcaaccgtcccgctggccgggcggcgcaactcagccccctctgtaaagtaggtttgttgcagacgcttaagggcgtaaaaacgcttgtcatcgtcccaagattgcaagttcccaatcgtgttggcttgctgtaggcggtaggtttccgcatcaaaggcgccgttttcgaccagggggttaaataatagctcctttaaaagggcgctcccccgttcaaacaggggggccttggctgcctgatcattaatcagcgctagcttgagtcggacggtgtgggccaagccaacccggctcacgtagccgctcaacgaggctccgtacaggtcgtttaagtggcgggctaacaccgtttgggtgcggtacttggccgacgaggttaccaacaggttcgccaccaagttccgggcactcggtgaaatttggcactgctcggtcgcaaagttcaccaaaatccgggtcaccttaaactgcttggtggcaataatgtgcaaatcaaccccggtggttaattgaatgtccaaggattattcttcctttcctaagcaaaacgaggccgggagaaaaccgtgttttctcccagccccttactgtatttccgaatactcgacagaaaacgtaagcactaaccaacgcccgcgtgtccaagtgcggacccaaccgctacgtgctgtagtggcttacgaccgcccctccaggcgaccggcttggttatttcccactttcgtcttcttattgatccgtttcaaatgatacgtgattaccagttaaattacaacctacttgatcttgtaattaaccgggcccaagaagttcgaggccttaccgaaccacttctcattgatctttttaagctggccgtcttcttggaggcgcttgagcccttcgttaaccttctttttcagggtcttgtcccccttgcgcatcccaacggcaaagtaatcggcgcccatcttgttactaatgtacgttgaataggacttggcgtttgcttggtgttggatgtagtagttggcgtagacttcatccatcaagatcccctggatccggttagcgtttaaatcgataaaggcgttcgggaaggtatcgtacaggatcgggctcttgcccttaatcttgtcttttaacagtttcgggtattcatccaggtcggtcatcccggtcgacccgttttgtacccctaacaccttccccttcatgtcgttaaagttgttaatgtggtcctttttcttggtgaccagtacctggcggtttaagaggtaaggcctggaaaaggctacttgcttggcccgttccggcgtcatcgagtacccgttccaaatcaggtcaatcgtcccgtttttcagttcggtttccttcattgaccagtcaatcgtctggaagtccaccttaatcccgtactgcttgaaaacggccttggctaagtcgatgtcgtacccaaccaacttcccgtcccgttcccggaagcccatcggcacaaaggaatcgtccaagccgacgattaccttcccccgcttttcaatccgcgaccaggtatcctgggtgccggcccgctgggtcacactctcacagccgctcaagaggaccgccggaatgacaagcaggaccaagacaaataagtatttcagtcgtttcatcccactgctccctttctactttctggcgtctaaggcttgcaccttcaagatcttgtcggcaatcttttcggcaaaatccatgtcgtgggtaacaactaactgggtcatcccctcctttttcagtgacaagaggaggttggccacttcatcacgcaggttcgggtccaaggcactagttggttcgtcataacacaggatccgtgggttcatcgccagggcccgcgcgatggcgacccgctgcttttgccccccggacaattggaacgggtagtggtcaccgagaccggtcaagcccagttcttctaacaattcggccgccttcttattggtctcgtctttactttgctttagaaccatcgttggcgccaaggtgatgttttccagcaccgataagtgggggaagaggttgaagtcttggaagaccaccccgatcacggcgtcgctttcctcggttccctgggggtcgaacggttgcccgtcaattaaaaaggtcccactgtcggcactctctaacccggtgatgcaacgcaacagggtcgtcttcccggccccggatggaccaacgatactgaggatttcaccgtcttccaccgtcaggtcaaccccgtttaaaatctgacgcccgtcaaaactcttttttaggtctttaatttctaacatctcaatccccccgattacttgtagtatgagtaccgcttttcaacccagcgcaggatgaccgtgcagaccccgaccatcagcaggtagattaacccaaccaagaggagtggcactaaggtaacgtcacgtgaggtggcaacgttcccggcccgcagcaagtcgcctaacccgattacgtataccaaggaggaatccttgatcaagttgatgacttcgtttccgattgacgggattacaatcttgaccacttgtggaatcacgatcttcctgaccgtttgccagtatgacaggcgcaacacccgggccccttcgtattggccctggctaattgattgcaacccaccacggaagatttcggcgaagtaagcggcgtagtttaagataaaggccaccaaggcggcatcgtaacgttggaaaacgattccgatgattggcaggccgtaaaagacgaagattaattgcagcagcaacggggtcccccgcatcagccagacgtacatttccaagacccacttgagcggcttgatcttagaagttaagcccagactgacgatgatccccaatggcaaggagccaattagggtccaaaagaagagttgcagggttaatcctgcaccctgaaataacgatggtaaaatttccatgatatatttaaacgacatggttgatcctcctttgtcttcccccattaagcaaattaataaaaaacgccccttgaatcgtggtgattcaaggggacgccttaacgtggttccaccccagttcattaccagctcacactggtaacctcagcaagtttacaaaagacaaaacgccctcctagccacttggctaagagggcgttgccgcggttccacctcatcttgtcgccccctcacggaagacgacctcagtaagttcacgaattgtaaactttgcgcgctaacgggcttccccggaccaccttttggtcagtggccaactcacagttgtgattcgaacgggagtactgtaaccttcccaccaccggttactcgctgatagcacgcatcgttctactaatctgctcaatgtcgttgttaatgttgtaagtatcttaactagatttgattttcttgtcaacagttctggccgaaaaattaaatttttctcatcgattctaatgttgctccccaagcgcccgttggtagaggcggtgaaccggccaatacaacaagatgaagtagaccaggttcagggccaaggttgggccaagggtatccaacaagaaaccggcaaagcccacccgggtcacccccaccaagtagtatgcccaatagttgagcaactccagcagggcaattgaaacaaagaaaattaaaatatgggataaaaacgacggagtgtagtagcggttgagggcccgggcaaacatcacgatggccgggtataagaacataaacaaccctagaatccccgagtagtaaaggtccgcacagatccccgctgcaacggcaaagccagtcaggggaatttggatatcctcttcaaaaaaggccccgaagatcagccacaaaacaaccagttggctaaccattaagtaggggtagctgaagaactggttggcaaagatcttgctcagtgagccatccaggaaaaaacaaataaataggccaagcgggaacaggaacctcagacgtgataatcggtacatggtaaccctccctacttaatcatcaagcttggcgacggtcacaatgttgatctcgttgaagttcgtggccggggtgatgtaaaccttttgggccagcccgtaatcatccgttccgatcttagccaccttaccgacgtagagtccctttggcgtgattccccctaatccagaagtcgtcaccgaggtccccttcttgatcttggccttggaagttacctgccccatgatcaactggttggttgacgagttgtagccagtgatgatcccgttaaccgtcttaccgttagtaccttgaatcgtaatggcaaagcggttcgatgattcactagtatcactaagcaactcaacaatactgttggtcttgttaacttgagaaacccggccgaccaagcccccaccggataagaccggcatgttctttttaattccggccgaggaacccttattgatcactaactgggcctgccaagacgacgggtcccggcttaaaacggaggcggcaatggttgagtaatcagtcaaagaggactttacctttagttccgcctttaactgcttattttccttggccagggtttggtccctaaccttaacttgggctaattccgtaacctgttgcttgagctccttgttttccgagtaggtattcattaactcgttaacgttggacagccccccctggatgatgttagccgggtaggttaccacgctaccggcaatcccgacaatgtcatcaccaaactgctggatcagaggcggcgtgctccgccggttccgtaaggccacggaaccggccatcaagctaaagcagaccacgagaatcaccactaaaataactaggcgacggtttgaaaaaaacttttgcatggaagaaagctcctctttagcccccgagaacgatgaacggggctgggcaaaaacattgttttgcaaccagccccgcccgtttcacgatttctcgttggtgatttatcaatgaaatccgttacttctttttgcgcatggcgtcgatgctcttcaaggattccccagtcccgatggccacacaatccagtggatcgttggcaataaagaccggcaccttggtcgcttccgcaatcacttctggcaagtgcttcaataaagcgcccccaccagtcagcacaatcccgtggtcgataacgtcagcggcaatttcaggtgacgtttcttccaacgtccccttgatagcggcgataatttcgttgaccacatcttgaagggcttcggaaacgtccaaggcggaaacctccatcgtcttcggtaacccagtaatcaggtcccgaccacgcacttcggttgtccccatttccttggcagcgtccaaggaggcagaaccaatgtcccacttcaacttttcggccgtccgttccccaatcaagaggctcttgttttggcggacaaattgggcaatggcgtcgttcatcttgtcaccagccatccgaattgaacgactggatacgatgccccctaaggaaatcgtcgccacgtccgtcgtcccaccaccaatatcaaccaccattgaaccggtcggatccatgactggcaggccagccccaatagcagcagcgtatggttcttcgataacgtaagcatcacgcgccccggcaacccgggttgcgtcaaccacggcccgcttttcaacttcggtgatcccacttgggacacaaaccattacgtatggcttaccgccgttgttgcccagcgccttgtccatgtagtacttcatcatggcaacggtggtgtcataatcggcaatgaccccatctttcattggccggatggcaacgatacttgccggggtccgcccaatcatgtcccgagcttcggacccaacggaaattacttcgccggtacccttcttacgtgcaaccacggacggttcccgcaagacaatgccctttccatcaatgtaaacaattgtattggcagttccgaggtcgataccaatatttttagttccaaatcctaatggcaatctgtttcttcccttcgtttgtacgtttaatacgttcttttgtggtaatccatatcgccgatattataccatagccaaacgttagattaacagaccctactatactataatggcccgggaattgacagatccgccctagagcgttaacgattatttaagatttcaccaatcggtttcttcctcttcttgacgggcctcgcgccaactatagtaatcccttctgcccaccacgagggcgtcaatcagggcgatgccaattaatttaccggcttcttccatccgtttaataaagatcatatcggccgttgaaggggccggagaaccggatgggtggttgtgggccaagatcaccccgtgcgccccggttttaatggcgaaacggaacacctgattaggataagtggaacactcactggtcccgccaatgaagagccgcttggtggcaatgattttattgtggacatcggtacacattgccaccaccatttcctgttcttcgccggcaaactcgtcgatcagcgccgtccccaccgaggtcgacgaggccgcctgcccgtagagatcgtggggtgagcgtaccgccatcgtccccaggttgaccgccgccagcagtggtttaaaggcttgttggtcgtattcggtcaactcctcttcttcttcggccgtgatgttatgtagcgcccggggagttgggaagcggtccaaaaaatgctgggccaagtcgggatccggcaaggcctcgtgaatcgtctggtggtaaagcgggaattgtaattgttgttttagcatattaaaacctcctcaccatctaagtacggtgaggaggtttattttaacgaaattagtctaataaaaattggcgaacttcggaaacaaagtacaaggagccggtgatgatgattacgtcgtcaccctgggcctcttgggccagccgggcgatccccaactgccagttagggacgtattccaccgggtagcgggtcgccagttccttaacggccaatcctaggtccgcactggggcggctcgctgccggcccggcaaagtgagtcaccagcaagtgaacgttggccaggctcgctaattcgcccagcatcagttcatactgcttatcggccaggatcgccacttccaagtagacctgccgatcaaaaaagtcgtccttgatcgtttgcacgagcgcctgcacccccggcaggttatgggccccgtctaaaatcatcagtggttcatcgttaactacttccatccgggccggccaggcactttcttctaagccccgcctgacgtccttggctagcaccggtagccccagggcggctaaggccagttggctaaccgtgatcgccacggcggcgtttgccacctggtagtcgccggccaggcccaacttaaactgggcccggtgtagccctagccccgagtatgaaacggttgggtacagggcgtggggagtgacgtttggtgcgtcaaagtcggtcccgagctcatacaatttagcgtggtgagctttggccacttgggccaccacttcccgggcactggtcgggaggtgaccaatgactagcggcgccccctccttgatgattcccgccttgtggctagcgatctgttcataggtgtcgcccaggtagcgcatgtggtcgtaaccgacggtcgtaatcgccgttaccaagggggcttcgatcacgttggttgaatcccacttgcccccaatccccacctctaaaatgaccaggtcggggcgttgctcattcatatagcaaaacataatcgccgtaccgatttcaaactcggtcggcccgccctccgttagctcctggtctaacaccgtcgccaccttggcgacccggttagcgatccgggtcaaatcttcgtcactaattggctgcccatcgatggccatccgttcgttgtagcgggtaatgaagggcgacgtgaaggtccccacgcgcaggccactggcgcccaagatgtccctagtcatcgccaccgtcgaccccttaccgttggtcccggtgatgtggatcatgttcaggccctcttgggggttgccgagccgctccaaaaagaggcgcattcttttgagggtcggaatttttttgaaccgggtccggccgtgaatgaaggctagggcctggtcgtaagttgtaatctcttccattattttcccttttcattaaaggggctgggaaaactttcccaacccctcatctgattcttaactatgacggataacgtggtccgctgagaaggttgggtcacacttcctgatatcgtgctcccaaccacgggcctagtggctaagtacgaccggagaacgatgcgttccgcatcaacccccgccctagcttagcccaacggcctgtcgagaaggttgggtcacactcactttatccttcttgcaggctcgccaagcgttccttggcgctcgctaacttttgttgccactcttcggccttggcccgttccttggccaccacctgttcaggggcgctgttgacgaacttttcgttccccagcttcttggttgaacgagcaacctctttttctagcttggtaatttccttttccatccgggcccgttcttcgtccaggtccaccagttcggccatcgggatgtaaaccgtggcgccggccaagatcccactcatcgccagcttcggcacgtcgacttcggtggcaatcgttaggtctgacgggtggcagaagcggtcaaggtaatcccggttttcgttgaagacggcggcgtgggcctgatcatccaccttaatcatcattttaaccggtgacgacattggggcgcccgcttggttccggatgttacgaacggccttgatcagttcgatcaggtcttccatttccccttcggccttttggttggccagttcgacgtgttcaaccgggtagtccgctaccatgatcgattgaccatcgtgcggcattgcctgccacagcttttcagttacgaacggcatgattgggtggatcagcttcagggtctggtctaagacgtaacccaagatgttcttggtggcgtccttttcttcgtcagtcccgttgttcaacttctccttggtcatttcgatgtaccagtcacagaagtcgttccaaatgaagttgtataggtcacggccagcttccccgaattcaaacttctcgaacttggcggtaacgtccttgacggtcgtgttcaagcggctcaggatccagcggtcggccaggtcccacttgctttggtccggcagttgtggcgccggcatgtcaccgaggttcatgatcacgtaccggctggcgttccagatcttgttgatgaagttccaagaggcgtccatcttcttgtaagagaagcggatgtcttggcccggcgttgaaccagttaccaagaaccagcgcagggcgtcaaccccgtacttttctaccacgtccatcgggtcgatcccgttacccagggacttagacatcttacgcccttgttcgtcacggatcaaaccatgcaagaggacgtttctaaacggcgccttgccggtgaactccagggattggaaaatcatccgggagacccagaagaaaatgatgtcgtagcccgttaccagcgtggtggttgggaagtagcgcttgaagtcttcggcatcggtgtttggccagcccatcgtcgaaaatggccacagggcgctggagaaccaggtatctaagacgtccttgtcttgaacccagttttccgcatcggctggggcttccattccgacgtacatctcgccggtttccttgtggtaccaggccgggatttggtgcccccaccagagttgacgggagatcacccagtcgtgaacgttttccatccactggttgaaggtgtgttcaaaccgttccggaatgaagttgactcggtcatcggtcttttggttagccaaggcccgttctgccagcggcttcatcttcacgaaccactgggtcgacaggcgggattcgacttgcaccccggtccgttcggagtgaccaacggagtgcacgattggttcgatcttgagcatgtaaccctggtcttggaggtccttgacgatcgctttccgggcgtcaaaccggtccatgccgacgtacttgccggcgttttcgttcatcgaggcatcctcgttcatcgtgtttaattccggcaggttgtggcgcttaccaacttggaagtcgttcgggtcgtgggccggcgtaatcttcaccatcccagtcccaaagtccggcgtcacgtaatcgtcggcaatgatttcgatttcgcggttaaccagcggcaccattacatgcttgccgaccagttccttgtagcgttcgtcgcttggattcacggcgacggcttcgtcaccaaacatcgtttctggccgggtggtggcgatttcaatgtagtccttgccgttgaaggtcgtcccgtcggtgaacgggtacttgacgtggtaaaaggcgcccttatcgtccttgtgttcgacttcgatgtcggataaggcggtccgcgccttcgggtcccagttgatgatgtaagtggcccggtaaatcaaacccttgttgtaaaggtcaacgaagaccttgcgcacggccttgtttaacccttcgtctaaggtaaagcgttcccggtcgtaatcaacggagatccccatcttggcccattgctggtgaatgatggcggcgtattcgtccttccagtcccaaacctgcttaacaaacttttcgcgacccaggtcgtagcgggaaaccccttgcttggccaaccgggcttccaccttggcctgggtggcaatcccggcgtggtccatccccggcagccacaagacgtcgtagccctgcatccgcttttggcgaatgataatatcttgtaaggtcgtgtcccaagcgtggcccaggtgcagcttcccggtcacgtttggcggcgggatcacgatggagtaagggtgcgcctttttatccccagacggcttgaaaaaaccttggtcgatccaccattggtagcgcccttcttcgaccgcttgggggtcgaatttggttgccatttctttttcggtcatttaaatttctcccttcggtaacgggtacaaaaaaaagacccgccctaacataggacgagtcttctcgcggtaccacctaatttgaagtggccactgccactccctctttgccatttgataacggtaaatgaaccgggaacccctacttaattcaggactcctgctcacgagctaccttcatgatcagagtgccgggatcctttccaccaccggatcctcgcttaggcggtccctctattcattactctctcgttcatcgcattgaatgacttaaatcatagataacttttcgccagccgtcaagtcctagagcaactttttcagggcggctaaagcggcgtcgtaatctggttcgtcaacgacttctggcaccacttgttcgtagacaatcttgccatcggcatccagcacccaaattgaacgggccaggatcccttcgtccggaatcaaaaccttgagggcataaccaaaggattgttccgaatcggccaccatcttcatgttcttaaccccttcagcggcgcaccagttttgctggtcttcaatcgtgttcgtcgacaccgttaagaagttggcgcctgggtattggtccatcagttggttgaacttcttggtttgaattgagcagaccgaggtgttgatgttaggcaccaccgaaatcaaagtgggcttgccaaacagttcccgggtcttgatcttttggttatcctcatcaaagaccttaaagtgcggaacgtcttcaccgacggccggcggatttccaactaattgacggtgttcaccattgatcgttacttccacgattgtggcctccttttaatgattctttaatctagcaactatgggttaagtatagcagattgggcttacctttcaccagaaaaacgcccaccgaaattggtgagcgcttggactgggtaaaggggtacacccttactgaattgaaaacaggttacttaagctggagcatgtcatcaacatctccatcgctcgtaatgcggtagttatcagcgccctgtaacttcccatttttgaaggtaaggccatctaatttacagtacagagttttttcgtctgagtcactgtcagaattagtgtaaaccaagatggcttcatacttattgccatcactataggtgtccctccctacgtaaaccttttgaaggtcacccaatttggtaatgctcgttgaataaacgattttggaatcttcttcttttttcttctcgctatcaacgtaattgactagcttactgtagtcagcactcttgtccactaatccgctgaccgtgtacgtgtggttccccgagccggtaaatttgtagtctggattattttcacgtaactcttttaagagtgtgcttgccttgacagtgactttatcaccgtttacgtaccccttgttatcgtaggaatcatccaagtcacccaaatctaacttcggcttaccggtgtagctaaattgaatgctgttctcactcttatgcttagattcaacaccttcagctttcatctttaagttactgtacacagaggaaaggctgatcgttttccgttccttcaaaccggaaaccttgtaggtcttcttgcttgcccggatcgggttcttctcttcggcgtccttagcaaccttaatttcaaacgtaaccttatcaccgttcttcagccctgatgtcgaggtttcctttccgttaacactgacagaaattgtaatctcgcttgcctagcgcttgaacagggagaggtgttccttgtcggtgtttgaaagatcaaagtaatgctcttctaggtagtcattaactttgtcgccatccaaaatatagctagtgttcgacccatccccaacgatcgcttcggtttccatcttggtcaacttagccttttttaccaagatatccccaattgacttgtagagttggtaacgcgatttgtatgtgatatagccttgcgtgtcgatcccttcgtacttcggttcaaagtacttgttttgcaacacgttgaccgtccggccgtgaatcaagacggcaatcacaatgcacttcgtgttcccagaagctcggtcatttatggccgagtagtccacgtgtaggtaaaaatctagcctgcgatgtagcgaagctgggggagttcaaagaagtaagaaaggttaccggtttggatgacgtattgaccgacacggagttgggataagtgaccgcgaacgttggtgatttgaccatcggtgtggaccggcattagttgaacaaagacctcccggtgctcctcaatggcccgggcgaggaattgccgccgctgaaagaggggttgaacgggaagaacccgtggttccactggttgggcttgctgaggggtttcaaataaagaagaccaaagggcggtcccccggttaattaaagaacgcttttgaatttgcatcgtgcttccctccgaacgtttgtttgtgactatattatacgaacggacgttcaaaaaggcaagggtaaaatcgatcatttgttcgtatttataaaatggtggcgagaattcgccattgacgccccggcaggtgggcaaagtgtggtatcatatatccaatacttttaaaaaaggttaggggtaagagcaaacatgacaaagcgaggaatgttgattgtcctttcgggaccatccggagttggtaagggaacggtgcgtaaagccatctttgaccaaccgggaaacgactttcagtattcaatttcaatgacgacgcgcaagccgcggccgggagaagtcaatggcaaggactacttctttgtttccaaagaggagtttgaacaaaaaatccaggccggcgaaatgcttgagtacgccaagtatgttgacaattattacggcacgccattaaaatggattaatgataccttagatgccggtaaagacgtctttttggaaattgaagttaacggggcgatgcaagttcgttccaagagcccaaacggcgtcttcattttcctaaccccacctgatctaatggaattaaagcaacgtctaattcaccggggaaccgacagcatggaagtaattaacaagcgcatcaagaaggcctttagtgagatcgaaatgatgcaaaattacgactatgcggtggttaacgacgaggttccaaacgccgttgaaaaagttaaagaaatcatccgtagcgaacggttacgggtgcggcgcgtgatgccggactacttagaaatgttaggagaatcgatgaaatgatcttatttccatccgttgataagctattagagcgggttgactcccgttactcactaatcatgttggctagcaagcgggcccacgaaatcgacaagtaccggatcgataagtggcgggcggcccacccggataaggctggcgaaacggtcagcttagaaggcgacaagccgctcttgttggaccactatgactccaacaagtccgttgggatggcgctggaagaaatcgaagcgggattggtaacgatcgaccccgaccaacacgaagacttacaagattaatgaccgggtgaaccgggaaaagtggccagggggatcccgggtcgctttttattttaaggaggaagacaggatggcaaggattgcggtatacctaacgggaagcattgcggcttataaggcagtaagcgtggtgcgggagcttcagcgcgctggtcacgaggtgcgggtggcccaaacaaaagcggcggagcagtttgttggtcccgccaccctggcttctttgacgcaccacccggtcgttgatgacctctgggaaatgagcgaagaggggcaaatcccccacgttcacttagccgactggtccgacttggccttggtggtgccggctagtgcggatgtaattgctaagatggcggcggggctggctgatgatgcggtcaccagcgccctgttagcgacccaggccccgcgtctggtggtgccggccatgaattcacacatgtggcaaaacccagctacgcaacgaaacgttacccaactgctggctgatggggttcacttcttggaacccgccgatgggatgttggcggagggttacaccggcatgggacggatgcccgaggttagcaccattatcgcttgggttgcggagtttttaaccaccggaaacgccttagcgggtaagcgcttggtggtgacggcggggggaacccgcgagccgctggatccggttcgctttatcggcaaccgttcctccggtaagatgggaattgcgattgcaaaagcagctgctaaccagggggcccaggtggaattgattgttggcagcgtgagtgtcgacttgccaaacgacgccggaatcactgttcgccaagttgaaaccaccgaggagttgttggcggccgttgatcaggcttttgaaggggcggacgccctcgtaatggcggcggcggtggccgactttcgcatggaagcagtcagtgaccaaaagatcaaaaaggatgcccacggggagctgatcctgaaactggtgaagaccccggatattttgaagacaatggggcaaaagaaggggcaccgcctggtggtggggtttgccgccgaaacaaccgccctggtcgaaaacggcatggcagagttaaagaagaaaaacgccgatttgatcgtagctaatgacgtgaccaaggtgggcagtggctttggggccgataccaaccaggtcaccattttggcggccgatcaggcaccccagacttggcccaagcttagtaaagcggcggtggcaaagcgactggtagcgctgattggtcaacgattggggggaaaaaacaaatggcggaactcgttcaagtcatagttgatgttccaacgatgcagaccaaccgcccctacacctaccgggtgcccgaacgcctcgagcgtcaagtgcaaccggggatgcgagtgatggtcccctttgggcggggaagccgggaggtccaagggtttgtggtcgccgttgaccaaccaggtgaatttgacggtgacttaaaggacctcgctggggtgatggacctaagcccggtcttaaatgacgagctactgaaactagcgggttggttggccgatcaaacctacgcctttaaaatcacggccttttataccatgttaccgagcctcttaaaggcccagacgacacggttggttcgcttggtcgatgaagttgatgagcaaacgaggctcgccctgtttgccgatcaggatgaattagaccttgccaaagttcaaactgatcccctggcactgagtcagttgatgaggctacggcgagcgggtaaggtggtaattgactatcgggttcacgaccgggcccgggctaaacaaatcaccaccattaccccaacgctgtcctttgatgattacgaaggggagcgactaggggtgttaaaaaacgcccacgcccagcggaatctattggattacttgcaaagcttagcggggaaaaccgtgccactcaagcaagcccaagaagagagtggcctttcggcggctacctttacgaccggggctaagcggggttggctcaaaaaggggcaagcagaagtttaccgcgatcccagtggggcgctgcctacgtcaccaactgccccgccgaccctaaatcaggagcaggcccaggcggtgaaaaggattaaccaggccaccgatcaacgaaccgccgaaactttcctgttgcagggggtgacgggttcggggaaaacggaggtttacctgcgggcaattgaacgggccttagctaacgggcgcagcgccctgatgttggtgccagaaatttcactaaccccgcaaatcgtcagccgggtgcggggccgctttggtaaacaagtcgcggtcctgcattcgggcctttccaacggggaacgctatgacgaatggcgccgaatcaagcgtggcgaggcgaaagtggtggtgggggcgcgctcagcggtatttgcccccctagacaacgttggtttgatcattatggatgaggagcacgagtcgtcttacaaacaagacgacgccccccgttatcacgcccgcaacgttgctaagtggcgagctgcttaccatcacgccccgctcgtcttgggatcggcaaccccgagcctagaaagccgggccagggcggcgaccgggttataccaccgcttaaccttgctccaccgggttaaccaacgccccctgccgccgatccaagtggtcgatatgaaaagagaggttcaagcgcggggggagactaattattcgttgccgctcttgaacttgttgaccgaccggcttaataaggggcagcaaagcatcctaatgcttaaccggcggggcttttcctcctttgtgatgtgtagggactgcggttacgttcctaagtgtcccaactgcgatatctcgttgaccctgcacatggatagccggagcctaaagtgtcactattgcggtcacgaggagcggatccccaacacctgtccgaactgccagggccaccgaatccgctactacgggaccggtaccgaaaaggcggtagccgaattgcaaacctacctgccgaccgctcggatcatccggatggacgttgatactacccgccgaaaggggatgcacgagaaattactaactaagtttggtaaccacgaggccgacatcctattggggacccaaatgatcgccaaggggttagatttcccgggggtgaccctggtgggggtcttaaacgccgacacggggctggatttacccgattttcggtcctctgagcgcacctttgacctcctagcgcaggtggccgggcgggccggacgtgccgatgaggccggccaagtggtgattcaaaccttcaacccggataattacgtgatccaactggcgcgggcccacgattacgagcgcttcttcgtccaggagatgaacctgcgcaaactcggcgcctacccgccgtattattacacggtccgggtgatgggcagccaccccgatgagcagatggccgcccgggtgatgcaagcggttcgccaggagttggtggggcagttggattcgcaaacgatcattttaggccccaccccccgggcaattgcccgcttgaaaaaccgttactattaccaaattgtgatcaagtaccgtcacgatccggccctccatgcccgcttaaccgcgatcatggaaggggcccagcaacagtttgaccgggagacccaggtgatgattgacccggatccccagtacttcttgtagatgtagaaaggaaaccacgccaatgaaatcaattgtttttatggggaccccccagtttgcggtcccaattttgaaggccctcatcgatagcgaagactaccaagtactagccgttgtttcccaacctgatcgtcgggtgggacgcaagcgcgaattacgggccactccggttaaggaactagcccttgaaaacggaattgaggttttgacccccgaaaaaattaatcacagccccgaaatggaccgggtgattgaactagcaccggacctgattatcacggcggcctttggtcaattcttgccggacaagctactcgccgccgctaaggttgcggccattaacgttcacggttccttgttacctaagtaccggggtggggcgccaattcaatacgccgtgatgaacggggacgccgagaccggggtcacaatcatgtacatggttaagaagatggacgccggcgatatcatcagccaggctagtttaccaattaccaagcaagacgataccgggacgatgtttgaaaagctatcactactggggcgcgaccttttgttagataccctgcctaagttgctcgccggcgatatcaccccggtcaaacaagacgaaagccaggttgtcttttcaccaaacatcacccgcgaacaagaaacgattgatttcacgctcccggccgaccgaattgatgacctcgttcgggggttgcgcccagccccggttggtaacatggtgattgatggcctacgaactaaggtttacgacgtgaccccgctaacggaaacgactgatctgcaaccgggccaggtggtgcgggtggaaaaacacgccctgattatagcggccggagcggggacgacttaccagattaacagccttaagccagccggaaagcccaagatggacattacggattacttaaacggccaccaaaatttaaagccgggagtacaagcgattaacaatgactaagaaacaagcacaattaacgggggcccggaccatcgccctggcgacgctagataaggtccgcacgtcgggggcctattcaaatctccagttgaaccaggccttagaaagcgggcaattatcgggcgctgatcgccgcctagtaacagccttagtgtacggaactctacagcaccaacggaccttagactactggctttccccctttatcgccggcaaaaaggtgcgcccttgggtcaaaacccttttgttaatgaccctctttcagtaccagtacctggatcgggtacccaactttgccgctaccgatgaggcgatcgaaattgctaagcggcgggggaaccctggggttcgtcgctttgtgaccggggttttgcacgcaattctgaggaacggagtggccgacgttgaaaaaattgaggaccccaagcagcggttggccatccaagcctccctgccggactggctggttgacgaattggtcgctcagtatgggctggcccaaacggaggcgcttgctaaggtaattaacgaaccggcacggatcagcctacgggttaaccgggccaaggccacggtcgaagaagcccaagcactgctaaggtcagcgggggtggaaaccaaaccatctgaggtcgcccaaaatggcttagtggttactaagggggcggtgttaaaaacggcggcctttaaaaacggggtggtaacgattcaagacgaatccgccatgttagccgtggaaagcatgcacctgaccggtcacgaacgggtcttggacgcctgtgccgctccggggggtaaaaccgttcaaattgcggaggccttaactgacggggaggtctacgccttagacatccaccggcataaggtgggcttaatcgaaaagaacgcgcaacggatgggggttgacgaccgggttttcgcccgccaactcgacgctcgccaggttggccaggaatttgccgaccagttctttgatcagatcttggttgatgcaccgtgttcgggaatgggacttttacggcggaaaccggagattcgctacgataagcaactgggcgacagccaacgtctccaccaaattcagggggcaattttggattcggtggccacaaaagtcaaaaagggcggtataattacctatagtacgtgcacgatccttcgtcaggaaaatgacgagacggtggccgaatttttaaagcaccaccccaacttccggttacaaaaaaccaccaccgcacgtatgttgaaggacaaccgccaagcccagacgctcaccctgttgccgagtgactacggctctgatggtttctttattagtaaccttcaacgagttcagtagaaggggaaaaagaaactcatggagactgcatttcaatcagatatcggtcaacaacggtccgaaaatcaggaccgggttaataatttttttgctgcgccaaacctccaattagtggttatcgctgatggagtggggggcaataatgggggcaacgtcgctgctgaagaaacggtagcggcgctcggtcgttacttcacccaggaggcacctaaaaccgtccgcaccgctaaggcgtggtttcgggataaggtccgcttggttaacaaattaattttaaataaagcaaattcaaatcttaactaccgagggatgggaacgacgatggttgcggcaatcctgattgataacgttgccgtggtcgccaatattggtgacagccggggttatattttccaccaggatttgttgacccaaatcaccgtcgatcactccctcgtcaatgaactagtcaaaaacggtgacttaacggaacaagaggccgcacattccccgcaaaataacattattacccgggcaattggaatctcaactgacgctgaaatcgacgtcaattcctttgaactcggggaaaatgatcaactactgttgtgtacggatggcctgagcaaaatggtcgaaggtgatcagattgcggccgttttagcgggacacgagtctttagaagataagtgtgccgacctgatcaagctggccaacgcggccggcggcaacgataacgtcaccgttttaattagccaaaacgaccaggagaaataacagatggaacccggatacgagctaaatcaccggtaccggatcatccgtccccttggtgagggcggaatggccaatgtctacttggcccacgacctggttttagaccgggatgtatcggttaaattattacggcttgatctgcgggatgatcccaacacgcagcgccgctttcaccgcgaggctttagcggcaacccaacttaatgatccccacattgttggggtttacgacgtgggagaagaccacggaatgcaatacatggtaatgcaatacgtcaaggggatggacctcaaggcgtacattaagcagcactacccccttccgctcccccaagtggttaacattatggaacaggtgctggctgccgttgaagcggcccacgcccagggaattattcaccgtgatctcaagccccaaaatatcttaattgacgatcaacaaaacattaaaattactgactttggtattgcgacggccagctcggggaattcgttaacccagacgaataccctgttaggttcggtccattacttatcgcccgaacaagcgcggggctcgattgccaccaagcgttcggacatctactcactcgggattatcctgtacgagttattagttggcaaggtgccctttgaaggggaaaccgcggtttcaattgcgctaaagcactttcgggaccgggttccttcggtacgccaggcgaacccggcgattccccagtcactggaaaacgtcgtctaccgggcgaccgccaaggaccccgcccagcgctatggttccgccgaagagatggccaaggacttgaaaacggtcctgactccggagcgagccaacgaggcaccactggtcttagcagacccaggggatgaggaaactaaggtcttggattaccgccaaatcaaggaagcggcggccaaaactaagcaggagccggaagcaaaagaagcccctgaacaacaagagacggctccagaacagccgcctgtcccgaaaaagaaacggcgccgggggttgtgggtgagcctactgacgattgttttagcaggtctactgggttcggggtggtatttcaaccgtgaagtaaccgtgccggacctgaccgggatgacgaccgctcaggcgaccaaggcgttagctaaaaagcacctgcgcttggggaatataacccgggaaacatcctcgtcagtggccaaaaatcggattgtcgccgttgatggtgccagcaaggcccgttatggtcgtgaagtgaacgtcatcttatccaacgggatgaagaagtggacaatggacgacctggtcggcaacgactaccaagggaccgccgaaagcttacgggccaaaggatttaccgtacggattaaaaaggagtattcctcttccgttagcgcagggcaaatcattcgtcaatcggtgagctcgggaacggtggttcacccggcccaagacgtgattaccctaaccgtatcggccgggaaacaaacttataagattcctaactttaaaaacgaggacattaccgacgttcaagactacgctagcaagcatggcctacaactgacggtgacccaacaggaatcaaccacggtagcggccaacaaggtcattagccaaactcccaaggcggggagtcgtttagctaagggggacaccctgacggtggtgattgcaagttcggggacccaactgaaaaccactagcatccaaatcgacatcccctttgatggtaacgggggcaagaccgaaaaccgggtccaagtttacattgaggatgcttaccacaacctaacgatggaataccaagacatcacgattaaccaggaaacaacgatcaacgtgccgttcaccctgcgcaacggtcaaaccggggcctacaaggtgatccgaaacggcaagacgatcatgagtgcaacgaacattaccggctaaaagcgataggaggtcgtttgtgaaaaacgggacgattcagcagtcactgagtggcttttatgacatttggtccgggggaaaactataccggaccagggcacggggaaactttcggaagcgggggttaaagcccgtcgttggtgaccaagtggagtttgaggcggaaaaccaacgggagggctacctcctaaagatcttgccccgcaagaatcagttggtccgtcccatggtggccaacgtcgacctagcggtggtcgtgactgccgttaaggaacccaacctgtcaacgaacctattagaccgccaactagtggccttggagagccaggggattgatccggtgatttacttctctaaaacggacctcctgtcggatcaagaagcagacgccctgatgccggtggtaaaaggctaccaaatgattggctacccggtgctttaccaacggcccccgtttggtgaggaggccttaggtgagttacgtaagatactggccggtaaggtggtcaccatgatgggccagaccggggcggggaagtccaccctgttaaaccacctggcgcccgatcttaacctggcgaccggggagatttcccaggccctcaagcgggggcgtcacaccacccgtaaggttagcttgatgcaggtgggcgacgccttaattgctgatacaccaggtttttcgtcgtacgaagacttccaaatgaccgtcgaggagttaccccacttcttcccggagatgcaagcactcgcgcccgaatgcaaatttcggggttgtttacacataaaagaaccgtcctgtgcggtcaagaatgcgcttaaacatggtaaaataatgaacagtcggtatgacaattacctccagttccacgagttaattgccaaccagaaaccaaactatcagaaatgagggaattgattatgattaaagttgcaccgtcaattttgagtgctgattacgtgaacctgcaaaaagacattgaaatggtggaaaagggtggcgccgaagtccttcacatcgacgtgatggacgggagttttgtcccaagcatttcttacggtccaggcttcgtaaaggcgattcggccaatctctaagatggtcttagacgtgcacctgatggttcaaaacccagaacacattttaccggacttcattgacgccggtgccgacatcattggggtgcaagtcgaagccacccaacacattcaccgggcccttcaaatcatcaagaatggtggggtcaaggccgaagtagttattaacccgggaacaccggttgacatgatcaagcctgtgttacacatggtggaccaagtgctggtgatgactgttaacccaggctttggtggccagaagttcctgccggaaacggtggctaagattgccgaattggatgctttgaagaaggaactgggttacgacttcgacatcgaaatcgatggtggggtgaacgaccaaaccgttgttgactgctacaaggcgggggcaacggtggccgtagctggctcctttgtgtttgacaacgaagatccagtggcccaaatcaacaagatcaaggacgcaacgaagtaacgcttagggacgtgacagcaaaatcactgatttccgtcacgcccttttttgatggggaggtaaggtcgtgagagaagtcaacatcatggtcggggggatcctagagctcgtgccgctagaccaactaaggacgcgggccaaccagatttggatcggggttgattacggcgccaccttcttgttggaccacggaatcacaccacaagtggcactgggtgattttgattcaacgccggcgcccctcttgcaacggttagaggagcggggaatctctttaacgacgttcccccccgaaaaggactacaccgacacccaattaggggtcaagcgggcctttttagactaccagcctgatcgggttaacatatacggggccaccggggggcgcttggatcagcttttgtctaacctctatttcccgctcttagaggaatttcagccctacttggaccggcttcacttaattgaccggcaaaacgaagtcacttactactggccgggtgagtatacaattgagaagttaccggagatgaagtacttggccttcgtcaatttaacctccgtcaagggcctaaccctgccagatgaaaagtaccggctcactaattttgatgccgaggtgcccatttcgtggtccagtaacgagtttgttggtgaggttaaccacttttcctttcaagacggggtggttgccgtcattcagagccgggattggggtgcccgttagctgtcaagggaaaatacttgaaagaaaatgttgcaatcaccgtgcccctatggtaaattatttaggtgagttaccgcagatgcgcggagaaaataatttgatgaggagaggagggttatcatggctaaggattttattactggcaagcggacgcagtttggtaacaagcgttcacacgcccttaactcaagtcgtcgcagctggaagccaaacttgcaaaaggccaccattttagttaatggtaagccgaagaaggtttacgtttcagcacgtaccctgaagttagggaaagtgactcgggttaactaagaacctaacaaatgcggctgccaatttttggcagccgttttttgcttgccaacgggttagttttgttgcccggggcgttgtatggtaagatatgatggatacaaattttacgaactgagttcaacgactaaaggaggccgttttggatggcagtaaagattaaaactcctgctggaatgatcgacattgcaaatgacgtcatcgcgacggttgttggcggcgccgccactgataactatggagttgtcggaatggcaagtcgcaacccgctaaaggatggggttaatcaaatcttaggacgtgacagcttccaccagggcgttgtcattcgtcaacaggataacgggattgccgtcgatgtgtacattatcgtcggctacggaaccaagatttccgccgtctccaagagcgtgcaagaaaaggtgaagtacaacttagaggcaatgctcggggtaacggccaactctgtgaacattatggttcagggcgtgcgcgtcctgggcgactagcgtgaccgagcgggaggaacaataactttggtagttacaacaattacaaaccatgaatttggcaagatggtgcaagccgcggccgccaagctgacggcccaagcggattacatcaactcgctaaatgtctttccagttccggacggcgatactgggacgaatatgtcaatgtcaatggcctccggggccaagtacgaacgggacgccacggccacggccgttggtgacctagctaacgccctggctaaggggctgttgatgggggcccgggggaactccggggtaattttatcccaaatcttccgtggctttgccaagggctgtgaaggggccgaaagcctcgacgctaaggccttcgtggatgcctacgctaacggggcaaagacggcgtacaaggccgtcatgaagccaaccgaggggacgatcctgacggtagtccgcgagtcggcccaagcggggttgaacgtagtcaaaaacggcgaagacgatttagcaattgtgctgcaagaaatcgttaccgctgccgacttggccctccaaaagacgccggagctcttaccggtattaaaggaagtcggtgtggttgactccggtggtcaggggctggtaacggtgctgcacggctttttagaggctttgactggccaagtagtcgaagacaccctgccggatgccgccaccctagatgaaatggttaacgttaaccaccgtcagagtgcacaagggaagctcaaccccgaagacatcaagtatggttactgcacccagatgatggtgcggattggccgtggtaagacggttaccaagaagtttgattacgacaccttctacaactacttagccgacctaggtgattcactcctggtaatcaatgacgacgaaatcgtcaaggttcacgtccacaccgagcaaccggataaggttttaggctggggacttcagtttggggacctgcaaacgatcaagatcgataacatgcgttggcaacaagaatcgatcatggaacacgatcaagagcccgcacagcagtcggcaccggctgccaagccggccgaccaaccgcaatttgaaacggcggtgatcgcggtggcctctggtaacgggatccaagaactgttcaagtccctcggggtgacccacgtgatcagcggtgggcaaaccatgaacccaagtatcgaagacttggttaaggccgttaatgaatcaggggctaaacaggccatcatcttgccaaataacggtaatatcttcatggccgccgatcaagctgcccaggtggctaacattccaaccaaggtcgtgcatgccaagacgattgcccaggggatgagttccttacttgaatacaacccagaggccaccttggaagctaaccaaacggcgatggaagcgaacttagctaacgtgaaatccggggaagtcaccgtggccgttcgcgacacgacgatcgaaggccaaacgatcaaggaaggcgactacatggggatcgttgacggcaagatcaccaacacggcgccggaaattgaagacgccgccgtccaaatggtggttggcatgttagatgaggacagtgaaattgtcaccatcctttacggtcaggatggaaccaaggaagccgctgaacggatttccaaggcgatcgaagacgtcgatgacgaagtcgaagtacaaatttacgaaggggatcagccagtttacccatacctgatctcagttgaatagctaaccgcaaaagcggggtggtccacgcggcaaccccgcttctagtgtttaagggggtgcaagcgtgcggtcgctacaggattcagttggtcaattgaagggtgtggggcccaagacggtggagaacctagccacgctagggatcaaaacggtgggggatttgttaacccactacccgtcacgctacgatgactttgcccccactgatttaaccgtggctaaggacaagcaaaaggtaaccgttaagggtacggtggtttctgagccgctgatgtcacggtacggctaccggcgctccaggatgtcctttcgtttggtggttgggcaagccggggtggtcaacgtggtgtacttcaaccaaccctacttaaagcaacaagttgagcccaaccacgacgtcacggtactggggacctgggacgccccccgccagcaaattctgggcaccaaattagtcgctgccgacagtaaggccgaggcagtcggggccacctacccggccaataagcacgttcgccaggccaccctacggaaactgatccggcaggcctttgatcagtaccaaaacgtgatcgcgaccctcctgccaattagcctgcgtcaacgctaccagctgatggaacggcgcgagatgatcaagcagatgcacttccccaccgacaccacgatggctgaagccgccaaacgaacggccgcctttgaggaatttttcttgtttgagttacgcttgcaagcgatccgacgggcgaaccgcaaggaagaggggctccagatcctctatgataacgcggaattacgggactttatcaaaacgatcccctttgagttgacggcggcccaaaagcgggtggtcaatgaaatctgccgcgacttgcgggccccttaccaaatgaaccggcttttgcaaggggacgtcgggtccgggaaaacgattgtagcggcgattgcggtcatggcggccgtcctggccggctaccaggtggccctgatggcccccaccgaaatcctggccgcccagcacgccgaaaagttggcgaaggtcttttccggtacccacgttgaggtcgccctgttgaccggggctttaaccgctaagcaacatgaccaactggccaaggccatcaaggccggtgacgtcaatttaatcgtcggcacccacgccctgattcaaaacggggttgattacgccaacctcggtttggtaatcattgacgaacagcaccgctttggggtcaaccaacgccagcagttgcgtgaaaaaggggagcaccccgacgtcttagcgatgacggcgacgccaatcccgcggaccctagccattacggcctacggggaaatggacgtctcggtgatcgacgaattaccggccgggcgccaaccgattaaaaccacttggctcaagggaaaccaggggcaaagtgccctggactttttggatcagcaactaagggccggcgcccaagcctacgttgtgtcgcccttaattgaagaatcggaaaacttggatgtcaaaaacgctaccgacctctacgctaggtttaaggaacactttggtcctacctaccaagtggggctcttgcacggccggatgaataacgacgaaaaagcggtggtcatgaaggactttcaagcgggcaaggtgcaagtgatggtcgccactacggtgatcgaagtcggggtcgacaaccccaacgccaccgtgatgttgatttacgacgccgaccgctttggcctggcccagctccaccagttacggggacgggtcggccggggcaagcggcaatcctactgcttattagtggccgaccctaaaaccgacgaggggaaggcgcggatggaaacgatggtcgccaccactgatggctttgaagtggcccaaaaggacctcgagttgcgcggggccggggacgtactgggggaccgccagtccgggatgcccgattttaaggtgggtgacccggtgggcgacctcaagatgcttcaaatcgctcgggcagacgccggcaacctcctggctaccccgggatgggatcaaaaggatgaaaaccagccactggtgttgtacttacagcgtcaccagttagaaacacactttgattaggagagaagagttatgaagattgcagttgatgccatgggcggagacaacgccccagccgttgtagtggaaggggtggaacgggcccgggaccgttttaaagacattgaattcgacctgttcggggatccccagcaggttcggcccctcattaaggacgccacccggattaatttgatcgaaacgacggaaatgattgagatgggtgaagaaccggtgcgggccatccgcaagaaaaaggattcttcgatcgtccgggcggccgtcgccgttaaggaaggccaagccgacgccttcttttcggccggcaacaccggggccattttagcggccgggttattcatcgttggccgaatcaagggaatcgaccggccggggttgacttcgatcctgccaattgccaaaccaggcagtggggcaaagaactttgtttacctcgattccggtgccaacgccgaaagtaaggaaaaaaacttgctccagtttgcccaactggggcgcttttacgccgaaaacgtcttaggggtcaacaacccgcggattgccctgttgaataacgggaccgaagaagataagggggaccgcctccacaaggaagttcaccaacaacttaaggcccaaggggatctaaacttcgtgggcaacgtggaagcgagcgccctcttggctggggaagccgacgtaattgtctcagatgggtggacggccaatgccgctttgaaggctaccgaagggaccgccaagatgatgttgaccttaattaaaaacgggatcgaaaacggtgggctgcgggccaagctgggctacctgttcttaaagccggttttcaaaaagattgccaagttgatggggacgtcaacctatgggggcgccgtcttattggggctcaaagcgccggtagttaaaacccacggttcggctgatgccttagcggttgaaaacacgatcgcccaaatccacacgatgatcgaaagcaaggtaatcgaaaaaacggtctcctactttggtcaggtccaatctgaggaaaacatagacaagccaagcaaaaactaatagaataaggtagttagtttagataaaagaggtattgaaagaatggataagaaggaaatctttgatacggtctcgtcaatcgtggccgaccactttgatgtcgatcgggccaagatcaccgatgacctgaatttgaagaccgacctgaacgcggattccattgactttgtggagtttgttctcgaggtcgaagacaccttcggcgcggaaattgaggacagtgaagctgaaaaactcagtaccattggtgaagtggttgattacatcgccgcccaccaaaaggactaacgctggtacgctaaaaaagggggtcgcgaaaacatatcgcggcctttttttgcaaaacggaccaaatagatgggtattcggtctgtgataaggggtcgtgggctcacgaccccctatcagaggcccgatcagaaaggacggacacgatgattacacaattgcaggattacctagccaaaacctacgggattcactttaatgacccggcgctgttggccgaagcctttacccaggcctcatacgtcaacgagcacccgcacgagaacctaaagtactacgaacgaattgaatttttgggggacgcggtgttacagctcttcgtctccgaatacatctaccgccgctatccggaactgccccaggggaaattaacccggctgcgggccgccatggtttgcgaggactccttttctaagtttgccaaggagtgccactttgaccagtacatccgcctgggtaagggggaggaaatggccggggcgcgcaaccgggctagccttctgtgcgatattttcgaatcctttattggggccctgtacctagaccagggacgccaagcggtcgaacagtttattcaaaccgttatcttccctaagcttgacctggggtggttcgatcacgccgtcgatgccaagaccagcctgcaggaattcctgcaaagaaacggtgacgtggcaatcgaatacgacctcctaagcgaagggggaacggaaaacgacccggtctttgaagtggaagtaaccgttgacggtaaaaaggttgccaccggccagggaagttccaagaagcacgcggaaatggaagccgctaaacacgccttagaaaaactacgaatggacaagtaggtgttgatcactcatgcgactactttcactagaaattgaaggttttaaatcctttgccgacaagaccgtcatcgattttcgaccggggatgaccggaatcattgggcccaacgggagcgggaagagtaacattattgaagccatccgctgggtgatgggggagcagtccgccaagaccctgcggggggataagatggccgacgtgattttcaacggggcggccgaccgcaagcccttaaaccgggcgcaggttaagatcaccctcgataacagcgaccactacttggattccgagtttaccgaattaacggtgacccgccggctgtaccggaacggtgattccgagtacctagtcaacgaccggccggtacggctcaaagacatcgtcgacctcttcattgattcagggattgggcgcgagtccttttcaatcatctcccaggggcgggtagccgccattttcaacgggaagccaaccgaccggcgggaagtgatcgaaacggtagccggcgttgccaagtataagcaaaacaaacgggccgccgaaaaacggctagttaccaccactgataaccttaaccgggtcaacgatatcattgccgaaatcaacgggcgcttggccccgttagccgaggaaagcgccctggccgaggagtacctagagcaaaagggacgcctggaccgcctggatcgtacccaaacggtccgccaaaccagggctaaccaagcccggctaagccaggttaacgaaaaggtcgtcaagggccgagagctaactaagcaatacgatcaggacgccaacaccgctagtcagcgccaggcgcagctagagggacaacggcgccaattactggcgacgcgcgatgagcaccaggctaagttgctagaggcgacccaggtgatcgctaaactcgaaaatcaacagtcgctctcctcggttcgcaaggaacagcgccaggccgaacaggaccggttgaccaagcggcaaagcgacctgacggaacaacaacgggcgctgacggaccaaataacggcggtcaatggcgaactgactaagcgtaaggaagccatcaaggaccaccaggctcagctgcgtcaattaaagacgatgagcgccgaagagcgggccgcccagctagaggagacgattgaaaacctgcgcaacaagcaagtcgacttgatgcaggaacaaacgacgattcaaaacaaccaactcttcttaaagcgggatcaccagcgtaaccagagccaacaagaagccggggccgccgccctcagtgaagccaagcagaagttggccgagctaacgaaagcggctaaccaacaggccaccgttgcccaaacggctgagcaaacggtccaagaggtggtacagcgctataaccaggagcaggccaaccaagcaaaactccagcaggaatacgaacagacttcccgccggtggtaccaagccctgggggacgtttcttccgccgagggacggattaaaagttaccaatcaatggcggccgattacaccggatactaccacggggttcaacaggtgttgcgtaagcgccaggcctacccgggccttttcggcgccgttagcgaactcctggaggtgccaagtcaatatacgacggcgattgaaaccgtcctgggtgggcaactacaacagttagtcgttgacagccaggcgaccgggaagcggatcattcaggatttgatccaaagccggggcgggcgggtaacgatcctgccactggataacctacgtggcggttttgccccccgcaacttggccaagttagtgaccatgcccggttacgtgggccgggccggggagttgatagcctatgacgctcgttttcaagtcgtggtcgaccagctcctggccagcacggtggtcgttgacaacctcgatcacgccactgagattgcccgggccgggcagcaccaggttcgggtggtcaccttagacggccaactgatcaacgcctctggggccatgaccgggggggccaaccgtaaccagcggacggggctacttcgccaacgccaacagttggccgagctagagcaagccgttaaacaggctcaggccaccgccagtcagttggaagcacaggttcagcgcctccaacgggcgcgtcaggccagccaggtcacccgcgacaaactggaacaagaactagcacgggcacgtaatgaggccgtggagcagggtaaccaggcccagcggcttcaagaccaggtaacggccgccgcccaaacggttacgtcgctggaataccaaaccaaccaacaaagcaaccagcaggctaactaccaaagccgggttcaagaggcagcttgcgaggccgcccgggttgaacaagagttggccgaggttaaggagcggaccagccgggcgcaagagcagttgaccgccctccagtccaacgccgctagccaaaacgaacaggttcacgagctcagccagtggctggccgttgaaaagacccgcttggaacaggacgaatctcaccgtagtgagctgttgaagcaacaaagcgaggtccaagccgccttagcggaaacgcaaggggcgctcgcgcagttatctaaacaagaccaaacgatggacgccgaacacgagtccagccaggtggccttagaagaatcccgggccgctctcaaggaccaccaagccgccgtcgaaaccgtcaccgaccagttagatcaagtcgaagcagacttgcggcaggctagcgaacgggcccaacgactgcaggacctgctcaaggtggccttaagtgatcaaaccaggctggctgccgaacaagctcatctggaaacgacgattgatcagggcttaaaccgcctgagcgaacgctaccagatgaccttggacgccgccagtcaggacatggcggacctagccgacgaagagctagctcgtcaaatcaagctcttgaaccgtggaatcgcggacctgggggaggtcaacacctcttcgattgccgaatacaagcaggttaaggagcgctacgacttcttgagtggccagcaagctgacttggtggccgccaaagagcagctcgaacaaacgatgaccgaaatggatcaacaagtcgagacccgctttatgaacaccttcaagcaagtttcggcggcctttagtgaaaccttcacccagatctttgacggtggcgaagccaagttgatcctgaccgaaccaagtcagcctctgacgaccggggttgacattatggctcagccgcctggcaagcgtaaccagcgtctatccctgttatcagggggggaacgggccctaacggcgatcgcccttttatttgcgatcctaaaggtccggccggtgccgtttgccatcctagacgaaccggaagcggcccttgacgcggttaacgttgatcgttttgcccactacctcgatcgcttcggggatcagggcccgcagttcattgttatcacccaccgtaagggaaccatgatgaacgccgacgtcttgtacggggttaccatgcaagagtccggggtttcgcggatggtttccgttgacgtcaacaccaccctagcacagcaccaaggatagaaatgaggggatcacatgggattatttgatatttttcggcgcaagaagcgcgaggaagtcgaccaggcaccggtagcagaagccagtttggctacgacacttgaccagccagcatcagaaaaagaagagacgaccagcgcggcgccggtagaggaagcgggcgcagaaaccgcggctcccaaagctgacgaccaaggggaagtggcacccgaaaaagatgaagctgttagtgctacaccagagcaagccgttgaagctccggcgtcggcggaagggtcagccagcgtcgcaccagaggaaccggtagaagaagtggccccaacggtggtggctagtgcggttgcggaagaaccggccgtcagtgaggaaccagcgccaagtgatgctagtgacgtggctgaagaaggtagtgacgattccgcgtccgcatccgtggccccggtaacggcggactgggtcaaccagatcgccaaaccggagcccactaccccggcttcaccgaccgaggtgattgaggcccaagaagaacttgagcaaccccaaaaagaggatcacgaccaagcagaagacgagccggcgccacaaggggaaccagccgcagaagacgaaacggaaaagaagtacgaccaggggctggaaaagtcacgcaacggctttggggcgcggttaaaccgtttcctggcgaacttccgccacgtcgatgaagacttcttcgatgaccttgaagacatgttgatcgaatccgacgttggttacgaaatggcgatgaagctctccgattccctgcgcgaagaggtccggttgcaaaacgccaagaacaagcaagacgtgtccaacgtgatcatcgaaaagatggtcgacctctacgatgaagccggggctggggaacaaactaccctgacgatggccgatcagggtccaaccgtgatcatgttcgtgggggttaacggggccggaaagacgaccacgattgggaagatggccgcccgctttaagggccagggtaagcgggtgcttttagccgctgccgataccttccgggccggggctactgagcagttggaagtgtgggcccaacgcgacggggttgacatcgtcaccgggccggaaaatagcgacccggcggcggtggtctttgacgccgtgaccaaggccaaaaaggacaattacgacgtcctctttgtcgacacggccggccggttgcaaaacaaggtcaacttaatgaacgagttggccaagatgaagcgaattttaacccgtgaaattccggacgccccgcacgaagtcctgctggttttagacgccaccaccgggcaaaacgccctgacccaggctaagttattcaaggaaacgaccgacgtgactgggattgtcttaactaagctcgacgggaccgcccgtggggggatcgtcttagccatccgtaacgaattacacctaccggtcaagttcgtcgggttgggtgaaaaggtgagcgacttagaagaattcaacgcccaagacttcgtttacgggctcttcaaggggctcgtgacggtcgattagcaaggaggatttggtaatggaactcgaaaaaaacgagcggatcaacgccctcttcgccttttaccaacccttgctgacggccaagcaaaacgactacttgcagctttactacgccgacgattactcgctgggcgaaattgccaccgagttttcggtatcgcgtcaggccgtttacgataacatcaagcggaccgaaaagatcttggagggctacgagcaaaagttacatctgtacgcggagtttgaagcccgcaaccagcaggccgatcggatccgtgattacgttttaagccactacccgaccgatcagaccctgagggatttaattgacgggatggagaacctggaagcaaagtaagtttggtgagtagaaaagattagaacagcgaccaggttaggagaaggtttttctctcaacctggttttgtttttgtgaattttccgcccccttgtttagatggagaaaacggggcgggtgtagtaaaattagaaatggttttggcaaagttgccacacgaatttgaaattattaggggagaaacacatggcatttgaaggtttaacggaacgcctgcaaaaggcaatggaaaaactgcggcgtaagcccaaggtgaccgaagccgatttacgcgaaacgatgcgtgaaatccggctcgccctgctggaagccgacgttaactttaaggtcgttaaagacttcgtcaagacggtgcgcgaaaaggctgccggcgcggaggttttaaagggcttaaatccggctcagcaaatcgtcaagattgttaacgatgaactgaccgaaatgatgggtgaaacggcaacgcccctcaataaatccgcccacatcccgaccgtcatcatgatggtcgggctgcaaggggccgggaagacgacgacggccggtaagttggccaagcgccttaaaaaagaagaaaacgcccgcccactcttcattgcggccgacgtttaccggccagccgccattacccagttgcaacaagtggccgctagcattgacgtgccggtctttgaaatggggaccgacgtcgatccggtcgaaatcgtgcgccaggggatggaagtcgctaaggaaaagcacaacgactacgtgatcatcgatacggccgggcgcctgcaaatcgatgaacaactgatggaagaactggctaagatcaaggaactcgctaagccagacgaaatcctcctggtggtcgacgccatgaccgggcaaaacgccgtcaatactgcccaagggtttgacgaccagttagacattactggggtagtcttgaccaagttggatggggacacccgtggtggggccgccatgtcaatccgggccgtcaccggtaagccaattaagtttgtcggtgaaggggaaaagatggacaacttggacgtcttccaccccgaccggatggcctcccggatcctggggatgggagacatgatgaccctgatcgaaaaggcccaggaaaacttcgaccaggaacaagccacccaggcgatggctaagatgaaggaaaattcctttgacttcaacgacttcttggatcaaatggaccagatcactaagatgggaccgctggaagacctcttgaaaatgatgccggggatggccaacaacccggccttacaaaacatcaacctggacccgaagcagttcgcccacatcaaggcgattatctactcgatgacccccgaggaacgggaaaacccggacatgatgaacccaagccggcgccggcggttagcagccgggtccgggcggccaatcgttgaagtcaaccggatgatcaagcagtttaatcaaatgcgcaagatgatgcgccaggtcaccaacgggaacctcagcgggatggaaaacctgatgggcggccagatgccaggcggtcgcctcggtaagttggcgatgaaccggatggcccggcaaatgaagaagaataaaaagaagcgcctgaagaaaaagaagcgctaagaaaaaaatcgtggaaatccacgatttttttagttaacgacaaaatacgtccaggtcgtttgcaataatagagagtgaaaggaggaattgaaaatgttagtaaaagtgacactacaatcagacgccgatgactaccgggacttactggtcgctaatctgaaacgagatggcgccgggctcaaggacttcccgcgccagggctttacccccatgtataagggggaagacctcaagctgggcgattgggtgctagtaccctttcaagcgcacggtgaagctgagaagattttgccggccgtggtaattgaaatcgtcgacaaaccggaggcaagcttttcctttaagatcaaggaggtttttgccaccttcacgcctagttcggccaccattaaggaagcgcaaaaacgggtcaccgccgacctctttgccaaggccgcacgccgggccgaattcttgaagcggttgaaaaagtaccgcaagttagccaaggacgacccggcgatggccgaactggtcaagcagttggaacaactagatgtcgacgggaactgggaggaactgtttgacttcatggtggaccaaccagacccagacctaatcgtctactagactacttgttaatcaaacgatcaccagttagaatgggaggaaaacgcagaggagtttggttttgggaggaatcagaatgaaaaaaacactcttattgggaacgctaacggtggtcgcattggaattgacggcgtgtgggagtacgccgtctgggcaccaaaagacaagtagtgcttcaagttcgactaagcaggcgcagactatttctagccagacgtcaaaagccacttcaacgagcagcgcgtccagcagtagccaacagcaaacctacacggatgccgagtacgccctgatggcctacgaaaaactcgatgggcagggaatggccaatttacatagcaattccgacagaatgaactggtaccaaaaggacaacaagttttcagtcgacttcgggggtcacagcacgaccatgaccgtcaataacaacgacgtcttggttgcctacgactcagcgaccagcaacgggatggggccggttcgacgagtagcgccagttctagttcggctagcgttagtcaggaagcgttgaacaagacctatacgatcatgggtcatacctttaagccggtctgggcagatgattataagtcatgcgttttggttggaacggatggggaaggtgaggccgctgaatgggcgccgaacgccattggttactcggttgaagaacgtaagcagggaatggaacaagtaagtgaagcttataaggaactctacggaaaagactagactaaacaaaaaacgctcgccactgggggggagcgtttttttattccagtttatagccaaagccgcggacggtcgttaggtggacgggcttttgcgaatcgtcctccagtttgtcgcggaggtgggaaacgtggatgtccacgattcgtgagctccccaggatatcgtagccccaaaccccgttaagtagttgctcgcgggacaagacttggccctggtggtcggccaaaaaggctaagagttgaaattccttgcgggtcaggctaacctcttggccggccttggtgacccggacctttttggggtcgatttcccagtcgccgatcttaatccggtcttcaatgattggttcatcgtcatcatcattggtggtggcgtcttcatcggccaccgtggcgtgttggtaaagccagcagcgttgttcgattagtggtcgtaaaacgtcgtgggcgaggtctttttccaatacgtcgtcgaccttggcccggaaaagcttgcgtcgctgccggtcatcgaggttgggtgagaaaaccagcagcgggccgttttgctggtggcggatcagggtcatggtggcgatggtggtgtctaagttagtggcagccaggtcccacaaaataccggtgtaggagttttgctcgaggttaaccaccagggcggtagcggtggtgacccggttgaggtcccagtgctggtggtggcaaaagtgggctaaatcggtcgcaaaggtttgatccttagtcatgagcagaaagtttttgatgatcgttcccccctgaatttacaaaagctttacacgatgaaggtggaaggtttacatggccttgttaaattatagtagaaatgcgagggcggatggccggcacccgtcagcccccgaggcgtcgcgtaacccggcacggttaggcagggcgcccagagttagactaagaaaagtttacaattgtcattatagcaccttgcttacccggcggggggaaatcgtccgatttgccgcctagggtgatggttgtaagccaaacgagaggattttgataatgaagaagatcattgggggccttggggttatattggtgctcttgctcggttggggctggttttccgcccggggcaatggcgccaccatcaccaaggtgactgacgtgggttcaacggccttgcaacccttggcagaagcggcgatccctggttttaataagaccaacccggacgttaacatcaccgttcagggtgggggctcggggaccggcttatcccaggttcaggccggcgccgttgacatcgggagctccgacgtttttgccgcccagcaaaacgggattgacgccaacaagttggttgaccacattgtggccgtgaccgggattgtcccgattgtgaaccctaaattaggggtggacaacctatcgatgaaccagctgcgcgatatttttgctggtaagattactaactggaaagaagtcggtggcccggacgaaaagatcaccgtcatcaaccgggcctccggttccgggacccggctggcctttgagcaagtggtgatggacgagcaggaaaccatgaaggcccaggaacaagattccaacgggacggttaagcaaattatttctaacgtccccggagcgatttcctacgtttcctcggcctatttaaatgaccaggtcaaagccctgacgattgaccacgtcatcgccaccagtgaaaacatcagcgataacaagtggaaactgtggtcttatgagcacatgtacaccactaaacacgccaaaaaggcgaccttggattacatcaagtacctgcagtccagcgatgttcaatcccacttggtcaaagaagcccgctacatctcgattcacgatatgaatgtccaacgggatgctaacggggtcgtcacaaagattggagagaagtaatgaacgattgggaaaagcgattaactggtccctccaaggaaaccaatcaggagcggctagggcgggtgttgacgaccctgtcgatcaccgtgattggcttgctggtagtgaccatcctggtctttttaggcagtaaggggctgtccttattctttaagtacggggtcaacgtgtgggacttcttgtccggcaccgattggtcaccgaagaagggcttttacggcgccctgccgatgattgtaacctcctttggggtgacgatgatggccggggtcgtagccctgccattatccctgatggtagcgttggcggtaacggaaattttgccagccaccttccgcaaggtcacccagccggtgattgaactgttggtcgggatcccgtcagttgtatacgggttcgtcggtttgacggtgatcatcccggtcttgcgccagtggtttggcggcaccgggtttgggatgctagcggccacggtcgtcttgttcttgatgatcgtcccgacgatggtctcgatgacgatcgacaccctgctagcggtaccggaatcctaccggatggcctcgcggggcctcggggcgaccaggtggcagaccatttaccggaccattttaccgagcgcgaccgggggagtcttgacggcgatgatcttcgggatggcccgcgcctttggggaagccctggcggtgcaaatggtggtcgggaacgcctcgattatgccaactagcctgatgagctcggcggccaccctgacctcggtcttgaccaccgggatcgggaacacggtcatggggaccgcggctaacgacgccctgtggtccctggccctggtactgttagtgatgtcactgttctttaacctggccatgcgcctggttaaccgcaataaggagggctagcatgaacccacaaaaaagtgaccggctggcaaccggcgtgatccttttctttgccgccattgtgagcctgatcgtgttaaccctggtggtttacctgctggcgattgggttgccccacgtttcatggcacttcttgaccagcccggccagttcctttacggccggcggggggattcgcgaccagctctttaactccttttacctggtcgtcttaaccctgatcgtttcggtgccgttatccttgggggcggccatttacctgagtgagtacgcgccgcaaaaccggctcaccaataccctgcggttggcaatcgaagtcctttcgtcattgccatcggtggtagttggcttgtttgggtacctggtcttcgtgttgcagtggaagatggatttctccctgttggccggggcactcgctttgacgatcattaacttaccgttgttgacccgttcgtgtgaaaccgccctgtctcaggtgcccttcttgcaacgccaagcgggtctggggctggggatggccaagtggcgggtgacaacccggatcgtggtgccagctgccttgccggggatcatgaccggggcgattttatcggccggccggatcttcggggaggccgccgctttaatctacacggccgggcagagctcgatcaacgtttcttacagcaactggaacccgttcagtcaaacgagttttctaaacccgatgcgcccggccgaaaccctagccgtccacatctggaagctcaacaccgagggactgattccagacgcaacggcggtctcggccggagccgccgccgtcttaatcctagccattttggcattcaacctcttggcccgcttcgccggtagcctggttgctaagcacttccgtcaataaggaggaacagtaatggaagaaaacattgcacttgaattaaaggacgtttccgtggcctacggggccgaaccgaccgttcacaacgtctcaatgaagttcaagaaaaatcaggtgtcggccttgatcggggcctcggggtctgggaagtcgaccctcttgcggagcattaaccggatgaacgatgggattgccaacgtcaccgggcaaattctctttcatgacgtcgacatcaaccaacccaaggttaacgtctacaaggtccgccaagagatcgggatggtctttcagcagccgaccccgttcccgatgtcgatttacgaaaacgtcatctacggcttgcgtttgaccggtgaaaaggatcgtcaggtgctagaccagcgggtcgaagagagtttaaagcaggccgccttgtgggaagaagttaaggaccgcttgaaagtcagcgccctttctctttccgggggtcagcaacagcggctgtgcatcgcccggacgctggccacccggcccgagatcatcttgatggacgaaccgaccagcgccctggacccgatttcaaccacccagattgaagccacgatgatggacctcaagaaaaactacaccatcatcatcgtgactcacaacatgcaacaggcctcacgggcttctgactggaccgcttttatgcaccaaggaaagctgatagaatttaaccaaacgacggaaatctttatgaatccacacgaacaagcaaccaatgactacctcaacgggaagtttggctaaagggggggaataacaatgggtgtaatttttgacgaagaattaaagaaactgcggacccgttttatggaaatggggatcgacgcttccgagcagatttataaggcggctaaggcctttaccgatcacgatagcgccctggcccgggaagtgttggccacggacgcccagatcaatgacgaagaaatcagcctggaaaagcgggcccttaagctaatggccctgcaacagccgttggccagcgattttcggaagatcatttcgattttaaaggcctctaacgacgtcgaacggctgggggattacgccacccacatcgcccgctccgccatcaacttcgacaagaaaaaccacaacggtgagatcgaaaaagaaattgaaaagatgactgagattgtgcgccagatgctggaaaaggtgatggacgcttacgtttacaccaacgaaaaggcggcttacgaagtggcggaccaggacttaaaggtcgacatgatttacgtgaccgaacaaaagcgggtcttagcggcgatgatgaaaaaccaggcggcgattccagccctggaaacctacatgaccgttattcggaacctggaacgggccggcgaccacatcgttaacctggccgagtgggtcatctacattggcgctgggaagttagtcgaattaaatcccggcaagaccgacccggacctggttaagcgtaagctaggtgaagctaagtaggcaatgtcgtaggggcgcctaaccattaaccagaaaaatttccgaggctgtcaagaaaaactactttacaatccttggaaaacttggtatattattacctgttagaaaaaaggttaaggaggtgtcactatgtcagtcaagattcgtttaaagcggatgggttccaagaagcgtccattctaccggatcgttgttgccgactcacgttcaccacgtgatggtcgcttcatcacttctcttggtacttacaacccgctgaccacgccaaagcaagttaagttcgacgaggacgctgtgatggaatggttacaaaagggtgcgcaaccttccgacactgttcgcaacatgctgcaaaaggccggtgttatgaagaagtaccacgaagccaagtacgctaagaagtaatggtgtgatcggtcatgaaagaggttgattttaaggggctagtggttgccttagtggcaccgctagtgaaacaccctgaggcggtcaaggtagaagaagaaaatacttctcgctaccatcagttccgggtgaccgttgcgtctacggatactggccgggtgattggccgtcaaggacacgttgccgcagccttgcggaccattgtcgaaggggctcgtgataagcgggtgaatgacaagaaaattcggctgatcattcatgaccaccgtcattagaaaactcccacaaaggcttgtgggagtttttttgaaagcgggcaaggaaacacgttcttttaaggacgtgatgaattgcctttttttgtacattaaggtagataaaagaaagaggaacgagcgaatggaactctatacggttggaaaaatcgttaatacccacggcattcggggggaagtcaaggtggtcgcaaccaccgacttcgttgatcaacgctttgccgatggcgccactttatacctggtgaaaaaggatcaagcgcccgtcgaattgacggtggaacacgcccgaatgcacaaggggctggtgttggttaagtttaagcagttcaataacatcaacgaagtccaacacttccgtgacgccgagttaaaggtggcggatcaagaccaagcggaattagaagaggggcagtactactaccatcaaatcatcggcttgacggcggaaaccgttgacggccgggtgctggggaagatcaaggaaatcctggccccgggtgctaacgacgtctgggtggtcgaccgcgaacaaaagaccgacctcttgttgccggtgattgatgacgtggttaaagaagtcgacttagctggtggcaaggtgatcgtggaactcttggagggattggaataatgcggattgatattttaagcctcttcccggacatgtttgacgctacgttgggtcaatcgatcgtgggacgggcccaagacgatggctttgttgatattaaggtgactgattttcgccagtacaccaccgataagcaccgtcacgttgacgatgccccctttggtgggggcgccgggatgcttttgcaagctcagccaatctttgacgccatggacgccattgaacaagaaaccaaggacacttatcccaagggccgcgtgatcctgatggacccggccgggcggcgctttgaccaggactttgccatggaactggcccaagaagaacacctgacctttatttgcggtcactacgagggctatgacgaacgaatccgccagctggtgaccgacgaggcctccttgggggattacgttttgaccgggggtgaattggccgccatggtgatggtggacgccaccgtccgctttgttcccggggtgttggggaacatgtcttctccgatgggcgactcgttttccaacgggctgctcgaatacccgcagtatacccgtccggctgacttccgggggatgaaggtgccggaggtcttgaccagcggtaaccacgaaaagattcgggagtggcggatgcgtgaatcattgaaacgaacgctagaacggcgccccgatttattaaaaaacgccaagctgagtcgggaacaacagatcatcttgcaagacctcaagctcgacttggatccggacgcaccgaagtagggggcccagcgtgaaaaaattaatcgctcgtctcttaaaacaagaggaccccagcgtctaccaattaaaggacggccaactggagccaaccctacgcaccatcgacttaattggcctagggaccgggatggtggtcggaaccgccatcttcaccttgccagggatcgtggccgccgaacacaccggcccggctgtgccgttagccttcatcgtggcggccatcggggctggactgtcggccctggcctacgcagaaaccgcctcggtactgccctttgccggctcggccttttcttggatgaacgtcttattcggcgaattctttggttggattgccggctgggccctattagccgagtactttatctcagttgcctttgtcgcctccggctggtcggcttacatgcagggctttctcgcttcgtttgggattaaactgcccaccgccctgaccgggggctttaaccctgccagtggttcgtacgtcgatattttcgccgccatcgcaatcttagcagttggttggcttttatcccatggggtccaccaggtcgcccggattgaaaacacgatcgtcgccattaagctcctggtgatcatcctcttcatcgtggtcggggcgacggccattcacacccaaaattaccacccctttattcccgcacaccggccggggaccacgtttggcggctggaccgggattatggccggggcctcgcagatctttattgcctacgttggcttcgatgcaatcgccgccaataccgctgaaaccaagaatccccaaaagacgatgccgcgtggtttgatcggcaccttagttttggggactagctttttcatcgtcgtttcgctggtcttggtggggatgtttaagtactcgcgctacgccaacaatgccgaaccggctgcttgggctttgcgcgagtctggccactacctgaccgccaacctcttatccgttgtcgccttgatcgggatcttctcggccttgattgccattttactggcctcctcacggctaatttacgcctttggccgcgacgggctcctgccgtctttcttgggtcacgtcgacgccaagcgggtgccaaaccgagccctgtggacgatcaccgtgttggcgatgattttggggtcgattttccccttcaccttcttagcaaccttagtgtcggccggaaccttggtggccttcatcttcgtttcgctggggatttacgccctgcggcgccgcgaagggaaggacctacctgaagcccagttcaagatgccgggttacccgatcttgccggcggtatcggtgatcttttcggccgttatcttttggaacttaaacgtcgatgccaagtggatgatggtcggttggtttgccatcggcctgctagtatacttcttgtatgggattcgccactccaccttggctaagaagggctaaattccgtttgcaatttagcgggagaaatggtacattagttgttggctatgtaagccgcataaacggtattccgctggttccaagggaattaatgaatgtcggcgaaaggaaagaaatattatgcgtcaaaatcaattgatcgaaaaggtaactgctggtcagttacgcagtgacattccggccttccgcgccggtgacaccgttcgggtacacgccctcatcgttgaagggacccgcgaacgtgttcagatcttcgaaggggttgttatcaagcgccacggtgctggtatctccgctacctacacggtacgtaagatcagtaacgggattggtgttgaacggaccttcccacttcactcaccacgggtggaaaagatcgaagttgtacgctacggtcgtgtacgccgtgctaagctctactacctccgtgaacggactggtaagagtgcccgcattgctgaacgtcgtcgcgacaagtaagctcttgactaggtcaatgcctaataaagagactggaatttattccagtctcttttttttatggaaatttgggctttttttggctagcgacatgatatgtccaagtggtgtgggagaatagtcattaagagaggtggtagtaaagaaaaggcggaataaaaattagtacaaattttgatataatacaaaagttatgtgaaagcggttttaaaaatattgggaattgagtaatgaaagaactatctaaacaagttaaggcactctgggggaagaagagcaacgttgatggtcaagaactgtggcaacctctagtggtgcacctacttgataccaaaaacgtaattaattggctatatagtcattggctaacggacgggcaacggaaggttatccagggtaatctttcggaagaagccggtcaacagttggcggagtttttaggggcagtccatgaccttggaaaggcaaccccagttttccagatcaagaaaagctataacggagatcaagacctagatgatcaactgatggaacagttgattcaagttggctttgatcacctgggggacctaattttagcttccccaagggagtctccgcatgctcttgcgggggaagccttgctagagcagtttggaatcgatcaaacggtgggagcgattattggcggtcaccacggtaagccccagtcaaatgttccccggacagaaattaatgaccacaccaaaaactattggcaggttgataatttggtaaaggcacgagagggtaactggttaaaggtacaacgagaattattcagcttttgcttacaggaatgtggttaccaaagcgttgctgacgttcccaccaacctgactcagccccaagcggtccttttagagggactgctgataatggcggactggttagcttcaaccgaatacttaggtgatgaccggtcgaaaccgctctttccgctaatcccactccataattcgatggaagatttagatcttggtgcaaggttccaacgggcgatcttgacatggcgggtggaagaccagtggttcccggaacaaattacagacatcgatgagcagtttcaaaagcggtggggctttaagccacacccagttcagtgtcagatggatcaagtaattcaagatacaaccgatccagggataattattattgaactagaaccaggggcggggaaaacggaaattgccttagaagccgttgaacaactcgcctacacaaatggcgaacaggggctgttctttggccttccaactcaagcaacaagcaacgccatgtttgatcgagttaacgattggcttgctaaggttgcaaaagatgatgatgcacaactaggaattaaactgatgcattcaaaagcggagtttaacccgacctatgcagatttaaagatccctcgagcccataacgttgaaggggaaagggctgttaccgtgaactcatggttctcggggaaaaagtcgattttggaagaattttcaattggaacgattgatcaccttttgttaatggggctaaagcaaaagcacctcttccttcggcacttggggatgagcggaaaagtggtagtgattgacgaggttcacgcctatgacgcttacatggattcgtatttaactaaggcgttggaatggttaggggcatatcacgtgccagttattgcattgtcagcaaccttaccgattgcaactaggagcgcattgatcgaggcttactgtaagggaaaatacgggaaaaagaagatcgaaggtgcactaggctgggacaagaatcaagcctacccgttaatcagtgtgcttgatggaaagagattggttcagaaatcagactttactaggaatacgaagggatacgctgtagcaattgagcggctgacggtggaagatggtgacttgatcaaagccgttcttgaagcagtggaagatggtggcgttgctggagtaatcgtcaacaccgttaaaagagtgcagatgcttgcgagccaaattcctgaggatattcctaaattaatcctccattcagcctttttagcaccggaccgggccaaaattgaaaccaagctgcggggattaattggcaaacacggtaagcgaccaaagaagatgattatcattggaacccaggtcctagaacagtcattggacattgactttgacataatgtttacggacattgcgccaatggaccttttgattcaaagaattgggcgtttgcatcgtcacgatattcaacgcccttcaaaattggtgactccgcaggtcaagattatggggatcaatgactatggtgactatgggagtgccaacgaggcaatttattctaagtatcttttgatgaaaacagaccagtaccttcctgaacaacttacaattccggatgacatttctcctcttgttcaggcaacgtacagggatgacggtgaaatggagcctgacttacgagaggcgaaaagggtcttcgacgttaagcataaagaagagctggacaaggccaaaaagtttcagattaagttacctaagcaacgggaatcgcttcatggctggctagatagtgaattggttgatgctaacaaagatgaagttcgtgctcaggcagctgttcgcgacatacaagaaacacttgaagtcctgatggtaaaacaagtcaagggtgattactacctccttgatgggcagcaacttgaagaggttgattcaaaaacgatcgctcagcaattgattcgaatcccggcggcggttaccccgaggattgacaagtcaattgaacttctggagacgcaaactgctaaaagctttccggattggcaagcagatccttggttgaagggagcgttagtggtagtgcttgatgagcaaaatagtgcagagctagggaactggcgaattcattattcacgaaagtttggtttaagttacgaaaaggcggatgacgatgaaaaacaggcattttaacttaatcaccgagccttggattaaggtcctcgatgagaattatcaggaattaacggtatcaatggaggaggttttaaaaaacgctcgccattaccgtcaacttgctggggagatgcgatcacaggacttggtaattctgcggttactattggcggtacttctatccgtgtaccaacgggttaacgcagatggtgaaccttatgaaggcctaacaatggacgaccgttggcaggtgacggtagatccggatctagattttgaagacctaattgaggaaatgcaggaaacctggcaaaccctttatgagggtggagagttctcacaggcggtctttgactatttgaaggcatacgaagatcggtttgatttctttggtgaacatgccttctaccaagtcggtcgggaattttatgatgcacatgtcccggcaaaaaagtggattaaaacaggaaatgggaaggttgcagtaaaggaaattaacaggagagtttctgaaagtaataacagtgctgctattttctcaccacgatcgaatgggttcaagaacagacttagtttagatgaatttgtacgatgggtgataacgtatcaaaattatactggggtctctgggaaaacaagcgttaatggtatgaatgatgtttcaaagggatggctttacagtataagtcccgtttatgttaaaggggctaatctttttgagaccttaatgctcaatctaaccctctttcaagatgatcaagaaaagtataggtatccaaagccagtttgggagtggaatttggaaatttacatcgatcatcgtgttgaaggtctagtcccagataatttaccagaattatatacggttttatcccgaatcacatatatagaatggaatggagattatccgacaaccatccaaggaaagttatcaagattcgatgaagtaaatgcgtttatcgaaccaatgataacatggcgtctagacaagaaagggtataagccgagaacaaagcaactatctgatttaagaatcgcaatgtggcgtaattttggtgattacgttggaaccaacgatggagaaacccgagtcccagggatcgtttggtggctaaattaccttactgataaaggtttcctcacccaagaaactaatattaatttatcaagtgccggaatgatagtaggtgataataaaaaatcacaaatgccagctgcggaattctttgatgattttacgatcagggcggatgttttattcgatccggatccgctagcggcacggcgctggccacggcgaattgaggaggtaattgaattgaccaaaagggtcggagaaacgctttactattttgcaaaggaggttgcagaactacgggattcaaacggtagtggttcgtttgctaatcgaatcagcgctgaattttatgaccagttaaatgagccattcttaggttggctagctagtttgcgtaatgaccaagaccgtgatgagaagattttggagtggaaaaaggcattgcactcgctcgtaatgcaaacagcaaggaaactagtccaggagtcgtcacctacggagatgcgaggaaaggattcgacaaacatcttcactctttataatgcaacgcaactgaagattcgaaagcaattaagttaaggaggcatgaaagaggatgtcacatatcagcaagactgtcgccaagatcatccatcagttatataacgatggcgatcttgataaggggacattagcaaaactcaggacggcgaattcgcttttgagtcgtgatgcgaccgcaatttggccattactctttgaaaacattgaagataagcaagacttaagccaaactggggagccatctttcgcagagaccgccatttttgcagctttaagggcatacgcaatctatcagcaggggaccgaagaaagcgtatttaagcactcagataactggagagagaatcattcactattccaagctttcggtcggttacgaagtgatccggattttacggattcactagataaacgggtaagtaacgttttaaccagcctgaatttccaaagcgctgaaaattcaatcacccaactcgtcaggatattgaagtcaaaggggcaaggagggcaaattgactttgctcagctaggcgaagacttgtatcgtttccaattcagtagtgagagtgctcgtcaggtcactctgaagtggggacaagattactactggaataacttaaaagacaaccaagaataggggagtaaatcatgaagaatttatacttagacattaacgtactgcaaaccgttccatcttctaatattaaccgtgatgatacgggaacgccgaaaacggccatctacggtggggtaacgcggagccgagtttcttcacaaagctggaagcgggtgatgcggcaagcatttatgactgatagtgagggtgcagaatggttaaacagccaccggactaagcatgcagctaagcttttagcaggacggattaagaagctttctgatggtttgagtgatgaagaggccttagaaaaggcactggaagcctttaatacaacgaaggttaagccaaagaaggataagaagactggcgaatacttaaccggggcgctgttgcaattaagtaatggtcaattagataagttggcccactatgttcttagccatgatgagctagacacaaaagagattaaagaaacacttatggaaaagtcgtcattagatttggcgctctttggtcgaatggttgcagacaatcccgaattaaatgttgatgctgcttcacaagttgcccatgcaatctcaacccatgcgattgtcccagagtatgatttctatactgctattgatgatgataaagaagatagccaagccggtagtgcaatgatgggaactttggcttataattcatcaactttgtaccgctacgctaacgtcaacattaatgaactaatgcataatctaggctcgactgagctgacgattgaaggggtcaagctttttgttaaggaatttatgttgacgatgccaaccgggaaggaaaacacctttgctaacaaaacactgccacaatacgtaatgataacgttacgtgaagacacaccggttaacctggtttctgccttcgaagaaccagtcaagtcaaatcacgggtacgttgaagagtcaattgaacgcttagaaaaagagtactctgatacccttaaattagttgaacaaccaatttacacgggcgtgctcacgactaagcaatccaacttaaaccaagtagctaatacggaagaattactggaccaagtggctaaatttgtgagtgagaaggtagttgatgatgaaaacgttaacggttaatttaacgggaccgcttcagtcatacgggaatgaagcgacttttgagcgtcgaacgacctaccattatccttctaagagtgctgtaatcgggatgattgcggcggggctaggttaccgtcgggatgaccagcggattgaatcacttaataaattagggattgccgttcgaatagatcagcgcgggaaaataatgacggatttccatactgttcgtccccagaatgccaaaaacagtaagttaacctatcgtgattacctacaagatgcggtgttcgtagtggcaattgggagtggggatgacaatctcatcggtcaaatcaagtacgccttgcggcacccgaagtttcaattatttttaggacgacgggcaaatgttccggcgggcgtactttggattgaggagtttgatacggatccaatgacggtacttaaggagttgccttggcaagcaagtgactggttcaagaagcggatgaaaaaggaactttactccgctgaggtagttgctgattgggggctggaaaaaggagcggacaggaacttgatccaggttaaagatcaggtgggatcgtttaacgtccagcaccgttaccataagtatcgtccagcgattcggaccttcgtgacgctaaaaaataatatgtatcaagaaaatagtggtgaacatgacgtttggtcgtcaatctagatgggggaaaatatgtatctatcaagagtagaagttgacactaaaaatcgtcaaaagattagtgatctaacacatttaggggcctaccatagctgggttgaagattcctttccgcaggaagtagtgaagggtgagcgtaaacgacacctttggcgacttgatcaagttcaagggaaggagtacctgttagtgttgagtgatgatcaacctaatatgaaccgtcttgaaaagtatggtgttcctggtagtgctcagtcaaaaacatatgatcagtttctgagccaaatccaaactggaagggtaatgcgatttcggttaacggccaatcctgtgcatcgggttaccgagccgggagagaaggcaggaaaggtttacccccacattactattgctcagcaagaaaagtggttgattgatcgggcagaaaagaatggttttacattgttaacgacggctgatgggtatcagtttgatgtggttggtcgcgatcgaccacaactgttacacaaggggcaacggcgggtaaagttgaatcgggtcagttacgaaggactgctgaaggttagtgatgcagatctatttaagaaacttttggtcaatgggatcgggaaggaaaaagcttacggaatgggcctaatgacggtgatcccagttcacgagaaagcatgaaaagtgggatgggggctgagaagccaaaactaactgagttaagccggacaagtgaccgaatctcctttctgtacctcgaacacgctaaaattaatcgacaagacagcgcgattaaagtgatggatgccagagggatagttttcgttccggtcgcattgattagcgttcttcttttaggtcctggggtagatgttacccatcgggcgatggaattaatgggtgattccggcttagcggtcgtttgggttggtgagtatggtgtccgacagtatgcccatggtagggcgctcaatcactcatcaaagctactggaaaaacaagctaagttggtctcaaatgtaaggtcacgggtagcggttgcccggaaaatgtaccagatgcgatttccaaatgaagatgtaactaagttaacaatgcaacagctacggggaaaagagggctcccgggtgaggaaggtttatcgtaaactttctaatgagacgggggtcgcttggaacggccgcgagtacaacgttgataattttgatgagggtactcccatcaataaggctctaacagccgccaatcaaacactttatggtttaagttacagtgtcgttgccgcattaggtgcctccccgggtctagggtttattcacactggacacgatttggcattcatttatgactttgccgatatttataaggccaattattcaatcccgatttcttttgagatgaccgccaagtatggcgacgaagatatcgctactagaacaagacaagcaatgagggatacgtttagggatggtaagttgctaaagcaaatggtccatgacctgaaattcttattcgaggttgaagatgaccaagacccagaatttatgagcctctgggacgataaagaaggaatgcaaaagttcggtgtccaataccatgaaataagcgaggagtaagttatgattgtaattgctctttcaaaggttccggcctcattacgaggggatcttactaagtggtgccaggagattcaaacgggtatttatgttggacgtttcagtgcacgaattagaggcctcctttgggaacgtattcagaaaaacattggtaacggtgaagcgaccattgtgtacacaacaaacaacgaattaggttacgcattccgctcaacaagggaagatcgtgaagtcgttaattatgatgggattccattattgatgcacctggagaaaccgccttccgacattaagcatggtttcagcgatgcagcaaagttccatcatgctaagcaagcgcgaaagggaaaagaaactgggatgactaggacagttgtcgcattggatattgaaacgaccggactaaactcagcgactgacgaaataatatcgataggggcagttaagtcaaccaaggggagagggcttgaacgattttatcggatcgtcagaactagcaagcaaattcctcctaaaattgttaaattaacgggacttaaccaacgaaaggttaatcaagaaggaattagcttagaagctgcccttacggatttcaaagattttattgggcacgcaatagtggttggttataatgttgcatttgactgggaatttatcgaacgagggtatgataaaataggacaagatcgcttaggtaatcgaattattgatttacttaaagtggttaggcaaaaggaagtctttttggataattttcgctttgaaacggttctaaaatactaccaaattgagaatcaggatcaacataattcactagcggacgccgaggcatcgatcaagctcatgaccaaactgattgaaaaagggtttttgaagatttgaaaatcgcttggttacagggatcttttagtgctccccatgtatatgggggtgatcccaccagtcacgccagtgcgggtctaacagcactgtgctccccatgtatatgggggtgatcctaacactaatccctacataatcatcatagcgagttggtgctccccatgtatatgggggtgatcccgttagcttgtctgcgtccagttcagaaatcgcgtgctccccatgtatatgggggtgatcccagggaaccaaatcacccttaaatcgggaaacagtgctccccatgtatatgggggtgatccctaatcgatcagttaagtccatttgagcctcctgtgctccccatgtatatgggggtgatcctgcttgggtttatgatgatgcttgggtttgggagtgctccccatgtatatgggggtgatcctgatcaaaaggtcgtggattatctcaacggcatgtgctccccatgtatatgggggtgatcccagcaacacggttgatcacatcgtgccgatcgagtgctccccatgtatatgggggtgatcctgtccaaaagcgcatggataagattaggcaagcgtgctccccatgtatatgggggtgatcccaactagaccgtgctggcctagagatgaattaagtgctccccatgtatatgggggtgatcccgataatttcaagttggctaatgatacattagagtgctccccatgtatatgggggtgatcctcacttcctttaccatatgaaaattaccagatggtgctccccatgtatatgggggtgatcccatcgccacacttcaggcttccgccaagacgctgtgctccccatgtatatgggggtgatcccgacaacgttggaaagctgttgatcgtgtctgtgtgctccccatgtatatgggggtgatcccttatatcgaccataatgggattcacaactacggtgctccccatgtatatgggggtgatcctaaactttattagcttcgctatccttaacactagtgctccccatgtatatgggggtgatcctacgttgggcatgttgagcggcttgcttttctggtgctccccatgtatatgggggtgatccccaaagttgttcactccatacatccacatcgcagtgctccccatgtatatgggggtgatcctactacaggaagtttaattgctagttttgtcgagtgctccccatgtatatgggggtgatcctgaaaccgaaatctgattagcacttgccccatagtgctccccatgtatatgggggtgatcctcttctcaccctcgtcaaagtcagcatcatcgagtgctccccatgtatatgggggtgatccctggatctatccaggccaagtgctcaagctaaggtgctccccatgtatatgggggtgatccttgtgcgtgtcctggtgaagctgcttcccggtcgtgctcaccatgtatatgggggtgatcctttcaataaaagtattgactttaatctaaagtagtgctccccatgtatatggggatgatcccaccgtgctcaccattctcggtctctgcggcttgtgctccttatgtacatggggggatcctcatcatcagaaagagccatagtgggcgagatgtctctagcattcgaagtgatgaaggcgaaattcttttccctcgtgggactcgattcaaagttgtaaaatactaccaagatgaaaatggtaaaaatataatcgaggtggaagaagttgaataaagaagagcggttaaaatggctccgagcccgtgaccaacccactgctgaacaattaaggtaatgggtaaaagacttgccgaaacaagaaataactcccgaagagcgaaagaaaagagagacttttaaaaaggccgccagtaaaatccttgaggttgataagcgtcaccaagagaggcaatcatggaatacagagaattcatcccacaaaaaaggctgactattgaaattaatggccagccttatgaagagattaagattacaaccaaagatactcatgagttggttgttctattttcaccggagaaagttgtttggtctaaaacatacaacgttagctttaaacgggatttaagtcagatgggaaccattgactagaaagagtgacgtttcttttggctatgacgatatgggtgctccctttgattaaacctatattcgctttagaggtttttaaaaccggccatgatgatcggttggggttagttgtttagttcaattaggtcatctaagactgaagtgcaacagaaaagttagacaaaattgaataattaagcttgtaaggcatgttcacggtattgaaccggggtcatgcctttcgtttttaaggatattcgttcgttattaaatcgccgaacgtagttcagagatagctgcttaaactctgctaggtttttgatcggttgtagcttttcatttgaggccgaattgctggcagccggcatcgaggtgcgccacatcaccgaggaggtcaacgtgccgatgtataacaccaacttacccctgcaaggtgccggcgccctgcacggtaacatggtggtgtcgatgcgaccaatcccggctagccaggtagctaaggcggtggaggtgacggcggcgatgcctagagtccacggggcaccaatccacgttggcaaccccgcttcgttagggatcaaggacctgtcccaccccgattacggtgacccggtcacgatcaaagacggggaactgccggtcttttggccctgtggggtgaccccgcaaaacgcaatcatgcaaagtaagctcccgctggtgattacccacgcgccgggctacatgttgatcaccgacgtcctaaacgccgacctgaagggtaacgggtgatcaatcaaaactttgatgaccaagccttgacaccccccctatagaaggggtacattattagcaatcagatgtcctttaagctagtcccgtgaggctagaaaggtaacggagaaattgcccagtttgggccaccgttgagcccttcacttgcggaatgcgagtggagggttttcttttgggacagccgagaataaaccatcaaattgctccagcgagggcaaaatggttacgctttccggattaaagacggtagtggtaacgattaacctccctggagcagcgccaagttgccccggggaggttttttctttggggcacagaaaaggagaatgtctcatgaccacccaactcgttgaacaactggtttctttaccacactttgtttccgtggaggatttaacgactgaccaagtcaacgccctgattgcccgggccgaagaattcaagaacggcgcgccgacaccgaaacttagccagccggtttacgtgaccaacatgttctttgaaaactcgacgcgcacccacacctcctttgcgatggccgaaaagaagctgggcttaaccgaaatccccttcgacgcgtcccactcctcgattaaaaagggcgaaaccctttacgacacctgcctaaccctggatgccttaggcgttgacctaacggtgatccgggcgtccgaaaacgactactacctgccactgatcaacccgggggcgggccactacctaggcctggggatcgtgaacggtggtgacggctctggtcaacacccatcccaatgcatgctagacatcatgaccatccacgaacactttggccactttaagggcctcaaggtggcgatcgtcggcgacatcaccaactcccgggtggcccgctccaacatggaaatcttaaacaagctcggcgccgaagtgtacttctccggcccggaatactggtacgaccacgcctttgacaagtacggcaagttcttaccgatcgacgaactggtcgaagaagtcgacgtcatgatgctcttacgggtccaacacgaacgccacgccggcgatgcccacgaaggggacttctcggcggcggactaccacaagcaatacgggatcaacgaggaacgctacgccctgctcaagccggacacgatcatcatgcacccgggcccgattaaccggggcgttgaactagccgactccttagtcgaagccccaaagtcggccttcgtcgcccaaatgaaaaacggggtcttcatgcggatggcgatgttagaagccgtactgcgcggtcgcaaactggggggcttggaataatgaaaaccctaattaaaaacgggaccgtctacaacgatggccgcctggttaaagaagacgtcctggtggaagacgggatcatccgggcaattggcaaggacctccacgagtacctagacgatgattacgacgaactcgacgccggcaacctcctggtcagccccggtttagtcgacgtgcacgtccactaccgcgagccgggccaaaccgaaaaggaaacgatcaggaccggttcggccgccgcggctcacggtggttttaccacggtcggggcgatgccaaacgtcgacccggtaccggacaccccggccaaggtggcccagatggtcgctaaaaataagcaggacggcctggttcacatcgcccagtactcggcgatcacgaccgaccggactagcgatgaggtggttgacatggccggcgtcaagcaggccggggccttcgccgtttccaacgacggtagcggggtccaagcggcggggacgatgtaccgggccatgcaggccgctaaggcggtgggcctaccgttagccgcccacgtggaggacgaatcgctgctctttggcggcgtgatgacggaaggggaccggtcccgctacctgggactacccggcgccccggaagtagtcgaatccgcccaagtcgctcgcgacctcgccctggccaaggccactggggtccactaccacgtctgtcacgtttccaccaaggacagcctggcgatgatccacttcgccaagcaaaacggcgtccgggtgacttgcgaggcgaccccacaccacttgctcttgtccgaccagtgcattgacggtcacgatagcaactacaagatgaacccaccgctacgccacgaagcagaccggcgcgccctggtggcggctttaaacgatggcacggttgacatgatcgctaccgaccacgccccgcacaccgaagaagataagggtcgtgacttttgctgcgcggccaacgggatcactggcagtgaaacggccttcgccctgttgtacaccaagttagtcaagaccgggctcttgaagctagagcggctcttggacctgatggccaccaaccccgccgaagcctttaacctgaccgaagccggtcacttagaggtcggtaagcccgccgacatcgccgtctttgacctcaaccacccctacgttatcgaccagcgtgactacctgtccaaggtaatcaattcaccctttaccgggatgaccgtctacgggcaaaccgtgatgacgatggttgacggccaagtggtttaccaacgaaaggagaactaacgtgcaacgctacctcgtcttagaagacggcacaacttaccgtggcaccgcctttggggccgaccaagccaagaccggtgaagtggtctttaccaccggcatgaccggctaccaagaggcgatcaccgaccagtcctttgccaaccagattctggtcttcaccaaccccctgatcgggaattacggtgtcaacctcgatgatgacgaatccctgcttcccgagatcaagggggttgtttgccgcaaactggcccgcgtcgccactaactggcggatgcaagacgacttggccaacttcttgacccagcgggggattccggggctggaggggatcgacacccgggccctggttaaaaagctgcgccaacatggaaacctgcgggggcggctggtcgatgacttaaccgacctggaccaagtagtggccgcattaaagcaagccaccccgatgaaaaacatcatcccgctcgtttccaccaagagcccctatcccaacccgggcaccaagcgcaacatcgtggtggtcgactttgggatcaagcactccatcttacgggaactggctaagcgcgactgtaacgtgatcgtcttaccccacaccgcgacggccacccaggtcctaaatttgcacgccgacggggtcctcttgtccaacggccccggcgacccactggaaatgacggcggccgcggaaatggttaaagaagttgaacaacacctgcccgtctttggtatttgcatgggtcaccagatcttggccctagctaacggtgccaagacggtcaagatgaagtttggccaccgcggtttcaaccacccggtcaaaaacgtggcgaccggcgaggttaacttcacctcgcaaaaccacgggtacgccgtcgacgccacctccatcgaccccgaccggttactaatcacccacgtcgaaattaacgacggcaccgtcgaggggcttcgccacaagcactacccggccttttcggtccaattccacccggatgcggccccgggaccgcacgatgcggagcagctctttgatgacttcattaacctggtcgaccaacgcaagaaaggacgaaactaatgccgaagcgcactgatattcacaagatcatggtgattggctcgggcccgatcatcatcggccaagccgctgaatttgactattccggtacccaggcctgcctagccctaaaggaggagggttacgaaaccgttttggtcaactccaacccggccacgatcatgaccgacaaggagattgccgaccacgtctacatcgaaccgctgacggtggcggccttgacccggattttgcgccaggaggcccccgacgccctcttacccactttaggggggcaaattgggttgaacctagccgtcgccctttcaaagaccgggatcctagacgaactgggaattgaactactggggaccaaactggcctcgattgaccaggccgaggaccgcgaaaagttcaaggaattgatgcaagaactgggtgagccggtcccggcctccttgaccgtcagcacggttgaacaggccctggcctttgctaaaaccgttggctacccggtgatcgtccgccccgcctttacgatgggcgggaccgggggtgggctagccaacaacgaggccgaactcgccgaaatcgccaagaatggccttgaactatcgccggccacccagtgcttgatcgaaaagtcgatcgccggctacaaggaaatcgagtttgaggtcatgcgcgacgccgccgataacacgatggtcgtttgttgcatggaaaacttcgatccggtcggcatccacaccggcgactcgatcgtctttgcgcccagccaaaccctggcggaccgcgagtaccaacgcttacgggactgcgcgttaaaactgatttcggccttaaagatcgaggggggctgcaacgtccaactggccctcgatcccaactcttacgattacaacgtgattgaagtcaacccgcgggtcagccgttcctcggccctggcttctaaggccaccggctacccgatcgccaagctagccgccaagattgcggtgggcttaaccctcgacgaaatcaagaacccggtcaccaagacgacctacgccgagtttgaaccagcccttgattacgtggtcgttaagctcccccgctggccctttgacaagtttaccaaggccgaccggcgcctaggtagccagatgaaggcgaccggggaagtgatggcgattggccggaccgccgaagaagcgctcttaaaggcggtcgcgtccttagaaatcgaccaaaaggacctcttgtcaaaagaagccgccgccgatagtgatcgccaactagaagacaaacttgtccacgcccaagatgaccgcctcttttacatcgccgaggcctttcggcgcggttattccctggctgacctccacgaactgacccggattaaccactacttcttagacatcgtggccgggttggttgaagaagaggggcggatcaaggccgctggtttggacaaggaggtaatttacgaagccaagcgcgacggctttgccgacacgaccttggcgaccctactcggccaaaacccggcagccatccgtgccttccgcaaggctaacgggatcgtgccggtctacaaaatggtcgacacctgcgcggccgaattcgactcggcaacgccctacttttactcgacctacgaaacggaaaacgaaagccgccgtagcgctaagccgtccgtcttggtgatcggttcgggtccaatccggattgggcagggggtcgagtttgactacgcaaccgtccactgcgtccgggccctgcaaaagttgggttacgaagcgatcgtcatcaattccaaccccgaaacggtctcgactgacttttcggtctccgataagctctactttgaaccgctgaccctagaaaacgtcttaaacgttaccgacttagagcaaccagttggcgccatcgttcagttcggtggccaaaccgccatcaacttagcggccgggttggaggcaaacggggtcaagatcttggggacgaccgtggctgacctggacgccgccgaggaccgcgagctctttgaccaggtgatcaaggacctgaacttgcgccaaccaatcgggatgaccgctaccacccgccagggggtgctagacgccgctaaggagatcggctacccggtcctggtgcggcctagttacgtcctggggggcaaggcgatggagatcgtttacggccaagccgaactggaggaatacttaaaccaaaacgccgacgtcaccggtagccacccaatcctggtggacgcctacttggaaggggcgtagtgtgaagtcgacgccatttgtgacggggaacgggtcctcttaccagggatcatggaacacatcgaacacgccggggttcactccggggattcgatggccgtttacccgccgcaatcactttcgggcgcggtaaaggttcaaatcgaagaggcgaccaagaagctggccgtcgccctcaagtgcgtggggatcatgaacatccaattcatcatccacgacggccaggcctacgtcttggaggttaacccgcgggccagccggacggtgccgttcttgtccaaggtgaccggaatcgaaatggcccagctagccaccaaggtgatcctcggccacagcctggccgaacagggttaccgaagcggcttggcgccggaaagccagatgattcacgttaaggcgccggtcttttccttctcgaagctgggggacgttgactcctacctcggcccggaaatgaagtcgactggggaggtaatgggttcggacaccacctacgaaaaggcactctacaaggcctttgccggggccggcatggaggtgccagataacggcgccgtgctgttaacgatcgaagacaacgataaggcccaaatcctgccgctggccaagcgcttcttggcaattggctaccggatcctggccaccagcgggacggccgctttcttagaagagaacggcttgcacccaactgtggtcgctaagctccacgaacaggggcaacccgctattttagacgtgattaaagacaagcacgtcgacctggtgatcaacacgatgggccacgacgacgaaaagaactccgatggcttcatcatccgccaaacggcgattgaacaccatgtgccgctcttaaccgccctagacaccgtgaacgccctgttgcgctcgcttgaaatgacgtcctttaaaaccactgaactataaggagacccaaccatgaccaaccgacttgccgtatccttacccggcctgaacatgaccaacccgttgatgcccgcttccggaacctttggctttggggacgcctggggtgccgaccaggttaactttaacgacctgggtgctttggtaattaaaactaccacccccgaggcgcggacggggaacccgcaaccccagattgccaagctgaccgacggggtaatgaacgccgttggcttgaccaaccccggcgttgacgccgtgatcaaagaaaagctacccaacttagctaagcagtacccggacctgccggtggtcggctcaatcggcggcagtaccgaaaccgactacgtgttagtggccgaaaagttagccaagtcggggttagttagcgccctggaacttaacgtgtcttgccccaacgtcgcccacggggggatggcctttggcaccgacgccaaggtcttggaatcgttgaccaaccaggttaaacgggtggtcggcgacgtcccgctgtacgttaagctgacccccaacgtgaccgatattaccgaggtcgccaggggggccgaagcggggggcgccgatggcctgtccttgattaacaccgtcttgggcttacacatcgacatccgcaccggccagccggtcttgggtaacggaatgggtggctactccgggacggcggttaagccgctagcggtccggatggtctaccaagtggcccgcgctaccaagttgccaatcatcgggatgggcgggatcgaaaccgccgccgacgtgcttgagtttatgatggccggggccagtgccgtcgccgttggggccgcccacttcaaagacatcgccgcttgcccccacattgccgctcaactgccggccttaatggacgagctggggattaagaccttggcggaggtcaagcgggtttaacaggggagagggggaaataacctccttgtaggtcagatgactaagctagggaattggtgcactccacgccgttcttcggccgtacttaggcactaggtctgcggttgtttgccacgttttttgtctaacattcagacatatagggagtgtaaaataaaaagaaaagagactgggaaaacagggctttcctagtctcttactgtatgtctgaatgttagacagataacgtggaaaataaccgcaggtctagtattctaagtacgggcgaagaacggtgcgtttcgcaccaaccgttcgccctagcttagtcatacgacctgctttggaggttatttcccactccctaattattcccaacccagctcttctgcgttggaggggaggcttagtttgccagcggccagttcggcaaaggcctggtcgatgatggcaaaggctttgtctaattgttcttcggtgataaccagcggcggttggaaacggaggatgttcccgcgcaggctaatgataatcgccccgagttcaaagatccggtacatcagcttggtggtggcttcaacgtcgcccttaccagtggccgggtcgacgatgctaatcccaccgttgagcccgtacaagcgggcgtcgccaacgaagtcgtacttggcttgttcctggtcaaagaagtccttggccttttgccctagcttcgccgagcgttccaccaggtgttcttcttcgatcacgtcgagggtggcgttggcggcggcggccgtcaccgggttaccggcggtcgtgtagacattggccgccgggccgagcgcttccatgatctcttttctgccgaccacggcgctcagtggcatccccgaggccagcgacttaccaaccgacatcaggtccggttcgatgcccgggaagtgttgaattgaccaccactttccggtccgccccatcccctggttgacctcgtcaatggcaaagaggatcccgttttgcttggcaaaggcatagatcctttccatgtaggcctggggaaccttgatgatcccgccgtccccctggattggttcaatcacgatcgccgcgacttcttcggccggcaggtaggtttcaaagggttgcaaaaaggccttgtacatccggtcgacaaactggtcgtcgctttcaccggctaacttgtcccacgggctcgggaagggcaccttcaccacgccgggcaagagcgggcccatcttacggctcatgtttaaggtgacgcttgagatcgtcatcgagccgtacgtggagccgtgataggccccggtgaaggaaacgatgtattggcgcccggtggcggcgcgggcaaacttaatgatcgcgtcgttggcgtcggaccccgagttaccccaggcgacctctaccggcccgctgatcggtgccaacgccgccaggcgcggggctaagcgggcggcctgggagttcgcaaagtaagcgggggtatattggatcagcctggccgcctggtcggcgatggccttgacgaccttggggtgggcgtggccggtattggtagagctagcactggccaagaggtcaatgtagtcgtggccttccacgtcggtaataatggcgccccgccctttatcaatcacaatgtcataatatttaattcgggccgccgaggaaaaggcctcttcttcggcagcgagcatctgctggttactttttttctcctccatgatcagtgtctcccttcttggccaggaatgagtgactcatcccgtatgcgaagtaaatgactaatcctaaaacaaaccatgccccagcgtagagctttgcttgaatgtctaagcccatgaacacgaagagggcagcgatgaaacctaaggccggcatgaccgggtaaaacggcatcttgaaggcggggttcggaatatccttcccttcccgcggccgcaaggcgtaaatccccagggaaacgaacatgaaggcaattaaggttccggcagaaatcagttgggataagaaggcgaacgggaagacggccccgattacgatggcgatgatcgtcaaggtccacagggcgcggtttggccgttggtgctcgtccaattgaccaagccatttcggcaacattccgtcacgcccgaaggagtagatcagccgggagccggccatgctcatcccgatcagggcggtgaacatcccaactacggcgatcgtttgaacaacggtggcgaccccaccgtgaccggcggcccgcagtgctaacccaactggttcggcggagttggcgtacttttggtacggcagcatcccgatcaggaccaaactaacggccacgaacagaaccacggcgatcgccaaggaccctaagatcccgcgcggcatcgtcttttgcgggttaacggcttcggcagagttggcggcgatcgagtcaaacccgatgtaggataagaagatcatcgaaaccccggcgtaaatcccttgccagcccccgaacggcccgttagccgtttcgtggtacttggggatgaaggggtggaagttagcggccttgatggcaaagaggccgacgacgatgaacaagagaatcgcgaagacctttaaaaccaccaggacgttttcgacccgagcggcttgcgaagcccccatcgcaatcaggacggcggccacggcaatcacgaccacggagatgatgtcgacgaccccaccgtcagtcccaaaggcgttggataaggagttcggcagggtgatccccattggcgccaaaagcccccgcagattggccgacagccccgacccaacgaatgccagggcgatgaagtactcggctaacagggcccagccggcaatccatccgaaaaattccccgaagacaacgttaatccatgaataagcggacccggcgaatggcatcgccgccgccatttcagcgtaggcaaaggccaccaggccggccacgacggcagcgaccacaaaggagatcgccactgatggaccggtgtgaatggcagccacttccccaggaagagtaaagatggaggtcgacacgatcgtccctacccccaaggctaagaagtcgcgcacccgtaatgatcggaccaggtgggcgtccttattagcgtatacgtgcggatcttccttccgcgtaatggttttccaaaaactcactggtttttcctcccgttgaaaattagatattaattagaataataagaaaagtttaactcattttatcaatctcaccgggattagtcaatgtttcgccgccgctaaattagatttttattagaatcaactagataatattatttcattaattaactaaccgccgttatttaaatcttctttgccgaggcggcgctttcattaccgtttccataattggtttagtccaaaaaagagtgggcccccactctagccccgtcgctaacaacggtcggccagtggtgggtacccactcctcaacgtagctttacttaaattggtgtcccagctcagccgcttcctggacgtgcttggccagctgacgcccgttctaggaattactagccaggaccgtgccggccggttgccagcgcatgtagtccagcagctgcttgaagtacagcttcatggaggcaaaggcgctgtcatcgccgtacccggaaatcagggtgacggcctgcttgccgccgtgcaactcgtggttgtaggcgtaaaagcggtcgatgacggccttcaaggcggcgttaatcccgtagtagtacagggaggttaccaaaacgaccaggtcggcctcgatcagcttgggcaggacctcgttttccaccacgtcatccgggcggacggcgacttccatccccgggcactcgtcctccagctgcaggagactgaactcactggcccggcgcccggcgtcaaagctaaacttggtggccgttttcccggaccgccttttcaaaggcatcggccagctgttcggacgttcccgggtggtgcgggctcccagttaaaatgacaattttcatggtgtttccccctttagtagtattacttacattatataaggggtagctgcaaatgggaaatgcttgacctgaggcgaagttgattcattttacctggctggcctcttgtagggcctggtaaaagtccggcaggtcgcggttgagccgcaagagcttgccgtcctggttggtaaagcagtgctccgaagtcccctcgcacaccagctgatcgtgacactccattcggtaggacagggtcaagcgcacccggtcgagggcggcaatcttggtggtgattaccacctggtcgctaaaggtggtcgagcgcttgtagcggcagttgaccgaaacgaccggtgagatgatcccggccgcttcaatcttggcgtaatcccagccgatcgccgctaggaagtgggtccgggcctcctccatccagcggacgtagttggagtggtgggtgatccccatccggtcggtctcgtagtactgaacagtgtgggtgtagaccgtcccggcggccgggaagaccaccttggtcaggtccacaccttggagcttggcgatgaccggcttggcggcccccagccagttgaggtccgctaattcttgcggggtcccccaccggaaggcatcgtgagcgaccgcggtcagggcgttgccttttaaaccagcgtaaaagacctgcatgtggacctcgccccaatcgtaggtgtgaacgacggttggtaaaacccgttcaccgatataggatgcggtccccagctcctcttttaattcgcgcatcagggcctggcggggatcttcaccgggtttgagcttgccccccggcaactcccaaaagccttcgcccaagcggcccccttcccggcgccccgccagcagcttggccccgtcaatgaccaccgccgctaccacgttaatctgttttgccattcgaatccctctctccgccggctatttcccgggaaattatttccgtcaccggcccttttcttctataataagcgcaaacgaaacggaggtcacgacaatggtagagaaacttgatctaaacacgccagaatacgcccaggtccacgatgccgccgcggtgcgcgaactggtcagccagatcaccgggcgcccggttgacgagagcaccgaaatccgcttgcccttttacaccgactgcggggtccggattcacctgggcaaacgggtcttcattaactcaaactgcatgttcaccgacctggggtcacgattggcgaaaacgcaattgtggcggccggggcggtggtcactaaggacgtggccgccaacacgatcgtcgggggaattccggcaagggtgattgggagaatttgagtgcgacccaacctcctcgacgggccgttgggctaaggataggacacaggttagcgcgccagcggtgttctgtggccagacttagccactaggcccgtggttggggagcacgttatcggaagtgcggaccaaccattggcaggccgtgggctactcatccgaaaactaaaagcagtggaccatggccgtctcgggtcatggtccactgcttttttcaattaatcatttagaaagtagttgcttggcggcttcaatctgggctttgacctggtcaaacccggtcccgcccagcgagttccgccgctcgacggccaccttagattggaggtcgtggtaaacgtcttcgccgatcgccgggtcgatctcttggtacttggccagcgggatttcctgcagggtcgtaccggtcttgagcccctctaagaccagttggccaacgatggcgtgggcctgacggaaggggatccccttggtggccaggtaatcggccagctcggtggcattggagaagtcgcgctccgtggcctgcgccatcttctccttgttgacgtgggcggtttcaagcatcccggccaccaccttcaggctcggcatgatcgtcttaacggcatcaaagagcccttccttgtcctcttgcaagtccttgttgtaggccagcggcaggcccttgatggtggtcaagagccccaaaaggtggccgttgacccggccggtcttgccccggaccagttcggccatgtccgggttcttcttttgcggcatgatcgagctaccggttgagtactggtcggacagctctaggtagccaaattcataggaacaccacatgatgatctcttcgcacagccgggacaggtgggtcatcaaaatggcggcgttggccaggaattcgaggacaaaatcccggtcggaaacggcgtctaaggaattggcgtagggcgcctgaaagtccaagagcttggcggtcagttcccggtcgatcgggaaggtcgtcccggccaaggcggccgcccccaacggcattagatcggtgtgctgttggttaaactcaaaccgttcgacgtcacgctggagcatctggaagtaggccatcaggtagtggccgtaagagatcggttgggcgtgttgcaagtgggtgtagccgggcatgatcgtttcgacgttggccgccgccttttcgaccaataccttttgcaagtccttgatcgcctggatgacgtggggcaggcggtgcttgacgtagaggtgtaggtcggtggccacctggtcgtttctgctccgggcggtgtggagcttgccggccaccggtccgatctcatcggtcaagagggcctctaagttcatgtggatgtcttcattttcaaccgtaaacgtaagctcccctgcttcgagttggtcctggagcttcttgagccccgtaatgatctggtcagcgtcggccgccggcaggatcttggtttcctttaacatcgtcacgtgggccaaggaaccctctaaatcttctgcggccatctgctggtcaaaggagatcgaggccccaaattcttcgacccacttggcaccggtcgcttcaaagcgacccccccacattctcttaactgccattaattcgttaccccttggtgttgtacttgatagataaagtccggcgccccttcgtccttcgttggtgccgcgggcttcttttgggctggcgcttggtcttgttggtggacctgggcgtaaacctgggttggcaagccgtacagcttgatgaagccagcggcggcttcggaatcaaaggagtcggctaccgtgtaggtcgccaggttttcgtcgtacagcgagtttggtgacttccgcccttcgcaaatgacgttgcccttaaagagcttgacccgcaccgtcccgttgacgtcctgttggctttcctttaagaaggccagcagggcagtcatcaacggcgtaaaccactgggcgttgtaaaccatgtcggcaatttgcttttcgatcaccggcttgaagtgggccagcgaccgttccagggtgatgtcttcgatgtccttgtgggcggccaggaggaccgtggcggccgggcattcgtagatttcccgtgacttgatcccgatcagccggttttcgacgtggtcgatccgaccgatcccgtgcttaccggccagcttgtccagggtcatgatcaaagtggccaggctcagttgctcgccgtttaattcgcttggcaccccgtgttcaaaggtcagttcaatgacgtcgggggtgtccggggtgtcttctaaggccaccgtccggtcgtaggcgtcggccggggcgctcgcccacgggtcttccaggatcccgcattcgttggcccggccccagaggttttcatcaatggagtacgggctttgcttgttaatcggcactggaatcccgttttccttggcgtagtcgatttcttcttcccgcgcccagtgaacttcccggatcgggtcttcgatcttcatgtccggcgccagggcgtggatgccgacttcaaaccgcacctggtcgttccccttcccggtacaaccgtgggcaatcgcggtggcgccgttttccttggccacctccactaacttcttgacgatcaacggccgcgaaagcgctgaaacgagggggtacttattttcgtacatggcatgggcctgcagggcgggcaggcagtactcgctggcgaattcttccttggcgtcgatgacgaccgacttaacggcgccgaccttaagccccttttccttgatggcctccaggtccttgccttcaccaacgtcaatgcagcaggcaatcacgtcgtaccccttgtttttcaaccaggcgatttccaccgacgtatcgagtccccctgagtatgctaaaacaactttttccttggccataagctcgtcctcgctttctattttcaatgattaattgtgactaaggatacactccttttgcatgaaaatcaaataaaaatgcaatattttcggaaaataaccgtcaaataagcacaaatcacggattgtatgcattttattttgtatattcacccccaggagttcgctaccaaaataaaaacgaccgtcccgcccgggcgatcgtttttttaatccgtactaaataagtagcgcaggctccggcccccggtggcgtggtggttaaccaccagcgggtgcggggctaggcggccgtggggccagctagttacccaaactggctgggtgcgggccgttgggttcgccaccacgagccggtaggtggcggcggctaacttcccgcggtaggccaccaccccaccgcggcggtggagggccagccgctgaccggcgggcgtcagcagggtcacggtcgcccggctcttatgcggcagccaaacctgggcccggctggcggcgtggtgaagcgtcaccgcctggctcagctgggctccaggggcgagttggtaaggccgttcgccgtactggaccgatagcgagctttgctgggtggcgacggtaatcgaattaggcttgggaaggctggttaacaggagcagcgccccgacgagaccgaccagcggccaccagaaccagggcagtcgtaccccaacgtcattgaagcggggcgccgtcggcaggctgacgagcccgaataagaacgggagcagggccaagccataccggtcctccacttcccacaagaggacctcgaaggccacgaagccgaccgcccagaccgccaagaggaccgcggtcgccgagtttaaacgcaggtaaatgaccttacgcaaagtcagggcgaagagggttaaccagccgacctgtaataggaagttttgtaagacaccggccagcttggcgtgggccaggtaccaagccggtgcccgctggggtccggcccggtactcaattggcacgtggcgctcatcagtcaagttaaccagcttggtcccccactgctggaagaggccgccgaccccgagtttcttaacctggttcactagggcgctttgaacgaaccgctggcgggtggccaaattgggcaaggtttcctcttgttgcaccacctggctgttgtactggcccccggtggccggcaggtaggacatgtagatccaagaggtcgccggcaggcggtagcggtcgtttgcttggtagtggcccgccgtcaggagcgcttgtttaaccggcaacgttagggccaaggcaaccaaaaccgtagtaaccggggccaggagctggcggcggggtttgaccaagcaccaggttaacaaaacggccggcgccaagacgatcaggttgggcttgatcaactggccgaccaggaccgccccgccgaggacgagtaacttcgcccagtggggccgttcttggtgggcctgccaaaccagcaggatcaccgccacagccaggatgctgggcaggtcgctgtaaggaacctgcaagaagttggtgtaggtgaccgagttgagcaaaaaccaggcgacgactaagatggcggcggccctgtctttggcgagtcggctggctaggtgggcacaggcgaggatcagggcgttggtcattacaaaacccagcgccccgagcgtagtggcgtcgttaaacccgactaagcgccccacccagagcgggccggccaagagaacggcgttgacggcgttattggggtagcggtaaaagtagtcgctggccccccagtcgaagtggccgctagctaacaggctggcctggtagcgcacccggaaggggtcatgaaagacgctggtcggcatggtcagtagcacggtcagttcgatcaccgccgtcaggccgagcaggccccaacacaggttccgtttggtggtggccgaccgaccgcttaaccaacgccaaacccggggggcgagggcgaggccggccaaaacgattaacagggcgccgcgcccttgtttaaggtcggtcctgaggttggcaatggtggccattaagaggattaacaccagcaccgccctgacgagcttagtcatacacgcaccccacgatatctttgagcgggtggtcgcgcaggaccgtcagcatccccaccaagtcggcgctcgactccaccatcccgtcgttgatccacagcatgatcacggcgcttacctcgctggcaaacacggcccgcccgtacttggccggcagtaaggtggcccgttcaaaatcggcttgcaaaaagtcctccatgatcgagactaactcccgcttgagaaccgtttcgatccggttggccaggccgccgtgcaccatcgccatcaccagttgctggttttgcttaacgtaatcgatcaccgcacggatgctgtccggcgacagagcgtggtgggcgggatcggcccgcaggatttggcgaatttggccaaacaattggccctccagccatgtttccaggtcgtaaatgtcagtataattgttataaaaggtgccccggttaatctgggcacggtcacacagttccttaaccgtgatctggttgaagccgcgctcctctagcagggcgatgaaggcttggtagaggcgggccttagttttggtttgtcgggtggcggtcatctttttctccttatttcaacacattattcaatttgttgcttgttcactttttttaagaatactacaataaggctgttaaataaacatatgtcgaattaaaagagtgaggtttagaaaatggcatacatataagtgataaacaacaccaagaccttcccgtccggtgacgagccgaccggggcgctggactttgaaaccggccgcgccgttatgcaaatcctccaggacatgagcagaaagcagggatcgaccgtcttaatcgtcacccacaacgccgccctggctccgatcgccgaccaggtcatccacatccacgacggccgggtgaaggagatcacccaccaggaccacccgcaagacatcgccactctggaatggtaggtgaagatcgtgagcaagaaaatattatataaggacgcctggcaatcgatcgggcggtcgccgggccgtttcatcgccctggtcttgttaatgttgctcgggaccttctcctttgtcggcctcaaaatcaccgggccggacatgcgccagaccgggctgaactactttaaccaaacccacctggccgacatgaccgtcacctccgcctacgggttaaaccaggccgaccaaaagacgatcgccgaccaagcacgggtcaagaccgtcaactacggctacttcaccgacgctaagattaagggcatcaccaacggcatccgggtcttttccaattccggttccctgtcgcagtataaagtggtggccgggcgcctggccaagacagacaccgaaatcgccttaaataacaccctcaagggcacctaccacctgggcgaaacgatcaccctgcaagatggcaccggccttgctaaaaccaagtttaaggtcgtcggtttcgtcaagtcggccgagttcatcaaccacaacgactttggccaaaccagcgttgggaccggccagttgagcggctttggggtcaccaccaaacgagccttctccctgaccgagtacaacctcgcccggatcagctaccgggataccgccaagctcaacgcctattccaacgcctacacgaaactgatgaataagcggcaagcgacccttttaaaggacctcaatcagcaccgggccgccaagtaccaggcggctaaggctagcctgtccaccgccttgattaaccaggacaccaacgccctcgatgccgccagcgtcgacgccaccctcaccctggttgaagacttcttgaccagccacggcctcaccgccgttcgtgaacagtccaccacagctaatcccgtgctggtcgacttcccggtgtaggtcccgtctttcatggtcgagttggaactgctagttgatgatgatgaagtagtggtggagctctccgattcggtatcactcgctgcggtggcttgactttgagccgtttcctggctttggtcatgtttgaagaacattaagtaaccgtcgattagaaccgctactgacgatgaaattgaaacgattgtaatcagaaatttcttaaacatggttgtcacctcgcgttttaaattgtttttttcttaacttggtaagaaccattttaaactagattaagggagaaactatgacgacgacgggtagaattgtgcccacttattttctagtttgttacgcattccacgctcttttatctgatagaaccaaaaaagccccgtaaaccggctcaagagccaatttaagggacttagattaggttaaggatttattaatcgaccgccagagcgtcaattgggttgagggcggcggcgtgccgggccggcagccaagccgctaacaaggagatgatcagggcgattacgaagaccgtaaccacgttgccaaaggtgatttggataaaggcgtaggtggcgatcttagacagggcggcgttgaacccggcttgggccacgaaggcaatcacggtggcgacgatcgccgagaagatcccgatgatcaaggattcggcgataaacatccggcgaatgtccttcttgctttcccccagcgcccgcaggatcccaatttccttggtccggtcggccactgacatgtacatagttacgatgatcatcaaagcggaaaccaacagtgagatcccggctaccccggacaagatgttggtgatcaagctgatgtaggtttcaatccgcgagatcattgaggaaacggcgttagcggtgaagacgcgcttgtggttggtcttgatcttattgatctgcttggcaactgacttggagttttccatcgtgttcgccgtcacggccaaggagctagcgtttggcttaacgctttggtccttcatcgccttagtcagggtcttggtgttgacgtaagttgcccccaccgagctgctggagattccggcgaccttggcggtaaacttaacggttaccggttgcccctggctgttttgggcggtgtaagaaagggtgaccgtcttgccgatcaggctcttgccactgcccttttgcagctttttggcgaccgtgttttggtccagaaccacttcgccggcgcccggcttgtggccgtacttaatggaagaattggtgctggagttgttccagttagttaaagtttgggcgacggtgctcttcttgcccgcggcgatcgtgacgttggcggccgtgtagatcttttgaacggcggtcacgtcacttaagtccttgatcttttggacgtcggactgtttaaaggtggcagcgcccttactgagttcggccatcatcgactgctggctggcgccagaatcgctacccccggatgcatcgcttcccttcacgtactgggtgacgattaccgaacgggggttaaccatgtcgttaacctgcttgttaacgtagccctggaccccgttacctaacccggagaagaggatcacggcaaagaggccgattgccgtgccggccacgatcaagaggttacgggcgaagtggaacttgaagtgcttgtaggccgtcgaaagcgaggtctcaaaggacaggggctttgaggtcaggcgccccttgtttttgtcgaccgggtaggccgggcgcaggcgctcgtcaccgtcgatttgcccctcggccaggtggacgatcctggtcccggaatcggccacgtgctgggagtgggtaacggcgatcaccaggcgtccttcggcggcgatctcatctaagatcttcaagacgtcttcggtgttttcggcgtccagggccccggtcggttcgtcggcgatgatgatcttcgggtcactggccaaggcccgggcgatggccacccgctgcttttgccccccggacaattggctcgggtacttcttagcgtgttcacttaagccaacccgcttcaagaggtccatcgtccggtcggtggcttccttggcgctcagggtggtcatgtctaaggacaagcggacgttttcggtcaccgttaagtggttgatcaagttgtaagactggtaaatgtaaccaatctcgtcgcgccggtaacgatccatgcgttgttcttggctgtgatcaagcttgttaccattgatgatcacttcaccgtcaaacttgcggtccagccccccgatgatgttcatcaaggtcgacttcccacccccggattccccgaggatcgagacgaattcccctaactcaaactgcaggttaatcccctttaggaccgggaactcttccttgccgaggaagtaagacttacgaatgtcttttaattctaagtaggccattgaaacactccattctctcaaagtaaaacttaaacatttggcgttaagatttaagcatgtgtcatattgtacccgttttgcggggtatgtcaataaagtttaacatcttagttaaatatttaacttttaaatttaagcttttagggtataatgggattctagattcaacaagtgggggtgaactcgtgaagcgcgaagaactcaaggaacaaaacagaacccagatcatcgaagcggccaagcggctctttttggcccaggggatccaaaaaaccagcgtccgccagatcagccaggagtcgggaatctcttacgtcaccatgtataagtactttgccgacaaggaggccctggtccaagaagttttaaccggcctgatcgacacgtcctttgcagacgcccaggcgacgatcaaaaactccagccagccctttttgcaacgtctgcaggcgattcccaacacctcctcgctcggcgccatcaccagtcaggcttcctacgaagagctttctaagaccatcgagactaccccgaaattgcgggcccacgtccgggccaagctggatgggctgtttaccaccttcattcagattgggcgccgtgatggtttcatcaccaccccggccagcgatgaagcgatcatcaccatcctaacctcgctggtttattatggcgatgccaacggccacgaacccgaccctaagcaagccgaagggatcgttaacgtccttttgtatgggctgacggggaagtaagcagtgagtgcgacccaaccaactggcaggccgtgggctaaggcctagacataggttagcgcgtcagcggtgttctatggctggacttagccactaggtctgcggttggggagcacgttatcattaagtgggaaatgaccttctcgacagaccgtatggctaagctaggacgaaggttagtgcgcgatctgtgtaacagcaaaaaaagagtctcggagaagcagcttctctgaggctctttttagtttagttaagtgcttttaatgcttgttgggcaatgttgtcagccgtcaagccgttttgggccaacagttcgttgacgtcgtagcggtccgggtaagccttttgcaggccgtagttttgcacccgcacggcgctgtcaccgaggtaggaggcgatcgtttgaccgtaaccgccctctaggatcccgtcttctagggtcaccaccacttggtgatcggcctggagttggtcgagcaattcggtgtccaacccggtcaggtaacgggggttgatgaccgtggcgtcgacgccctcttcggctaacttagcggcggcttgcttagctaagccgagcaggttgccgaccccgaagatggcgactttggaaccttggtgaaccacctggttcttgttcaagtcgccgtaatcggtggtgtcagcttggccggttgtttccaacgccacggccggaacccgaatggcaaccgggtggtctggttgatcaatcgcccagttagtcattgcgaccagctcttccttgttggttggggccaagtaaacgaagttcgggatgtggctcaagaacgggatgtcgtagaggccgaggtggctttcgtcgttcatcccgtaggcgccggccaggtacaccaggagggtcgccgagttaccatatgagtacattgggcaatatgagcaaagaagttgtcgagaaatatatcaatgaccaaaaatatacagaaacaaacaaaaagccccataaaggggctcaatagtggcctatccatcccatgactaaagtcacgggatttccggctaatattaattaaagctgactttaggtcaaggggcacaccctaatttttttcgatgaatttaacggcggtcccgtaggccaccaccgactgcatgtccgaagcgatcgaaccggagtcaaaccgcatcatcacaacggcgtcggcgcccatcgccgccgcctcttctttcaaacggttaatcgcctcctggcgcgaggtggtcagcatcttggtgtaacccttaatctcgccgccgaccaggttcttaagtccggcgccgaaattactaatgatgtcccggctttgggtggtcaccccaaagcactcgcccaacacttcgtattcttggcccggaatccgttcggtcgttgtcactagcatggtggttcctcctttggtgggttggctacggttattaccttaattatcgcataattaccaacttaatggtaggggcgctgctgctttactccaacaaggacaacccacttaaagactagcgtaaattgagcgcgtcccaggccatgtgctcggccaccgtcaagccgaccagttcggcgttttgatcgagctgggtcaacaggttcgccacttctggcaaggttaattggcccacggtggccgggaagtccgccgggtcggtccctggttcggccgggtaaattgagcgaaaagccgtgggcaacaaggcgtcgaggtcaaagtgaacggccacctgcttgaagccgtggccgcggacccaatcactaagggcgttcggagcttcgcgcagctgctttggcgtcagccgttggacctggtaatcgaaaacgttgtggtccatcggccgtaggtcctcttcaatcaaccccgccaagatgacctggtcgcttgcaagggggtggtgggcgttaaagcccagcgcccccttgcccagcagggagctgaccaccatttcgtggaggtggtgggactcctcggtcgtggagatgtcggggtgggtatccagccaaacgacccccaggtcccgaccgtaacgcccactcaaataatcaaagggggccaggctgacggcgcagtcgccccccaccctcaaaaccttgtccggttgcttggtggctaagactccctggaccgccgttagttgaccttgcaaggcctggtaggcatcgatgccgtgttggcctccaacacctcgggggcattaacgtcggcaaccgggatcgtcaccgttggtaattattcagccggcacgatcaaatccattaagcaggcccctaagacgtagttggggttcaccccaccttcccactggggcaagataatctttaagcgcttcatttgatcccctccattaattcttcaaccagctcggcaaccgttccaccgtgcttgatcaagtccagcccggtgttggtggaaataatgttgtcgtccactttccccaggcgcaggcccggcaacatcccgccgcgttgggcgattatttggtcaattgcccgtccgtcattggtttccttaaaccgggccgctagttgcttagcccccggggtcattaacgagcgctggtcgtgggagaccaaatcgacttgatcgtaagaccccgccaacagggtctccttggcagccggggcaaccggggcctcagcagtgactaagaagcgggtccccacgtaaaccccttgggcgccgaggaccagggccgccctaaccccacgggcgtcgttgatccccccggcggctaggaccgggatcgaaacggcatcggccatcgtcggcactaccgtgaaggtcccctggaagtgctggggcaagatccccccttcgtcgtagccggtcgccactaagatgtcggcgccgtaggcctcggcggctttagcattagccacggttggcgttagtggccgggccaagattaccccaccgtggtccttgatccgccggtaaaccgcctggtcgggttcaccaaccacggcaaagtagcggagcccgttggcaaaggccacctcaagcgtgctgttcatgtggggcgccgggtccggttccaacaccacgttgataccgattggctggtccgtcagggtgcgcacttggtccaactgggcttgcaactggcgctcgtgggccgctgagccgtgcaccatttcgctcaggccggcgttggggcccaacaccccgagggcaccggcgttggcgacggcggccacgaaccgggcgtcggtcgcccagttcatcggggcctggacgagcgggtacttggtgtgcaaaagttcggtaacggatgacattggtttcctccttaaatttacatatcgctaattaacgatctaacggggtgaaaattaaggaaccacccttacagtgattcctcaattagccgccccagtgcttgcacctgggcttcattacgccggtagtaggtccacttgccgtgccggctggaggtgagtaaccccacctcttctagcatggctaagtacgacgaaatcgttgattgggccaggccagccttacggacgatgtcgcccacgcagatgccgccgaagtggtcgagttcgtattgaaccgtctcacaggttacgacgtcgatatgggtgagcgggtcttttaaccagcgcaagatatcgaggcgggtttggttggccagggccttaaatagcttttcatttatttccatggtctgattatagatcggcttttatcgatctgtcaattccccaccgctcactttccgttaacgatctccacgaaccggctcttgagcgtcgtgtccttagcgaccgtccagttatccggcccctccatggtctggttgatcaagaccaccggcttgccctcgtgaaaggcaaaggcgtaagtggtccgccccaggtccttgggctggttgtaattgtagacggcgaccacgttgtaatcgtaattaccgctcccagtgtccgtccaccccatcgagacgctacgcatccccacgaaggcggcgctaaagccggtcgggtaactggttcccgaggcggttaccaggtcgctgttaccgttgtacttggcgtaggtttgcttgtccgctgccccccacttagccatgaaggccgccagttggttatccttaccctggttccagcgggccgtcgttgacgaattggtggttgaactttgcgtcaccgttttaatttggttgttgctgctccccgactccatttctgggtggtgcttcggcccgcttggcaagaatgcccataatgccaagagggccaccacggccagggtaaagccccctaggcccagccatctcttcttcattccgatcgcctctctcgctctcttcttaattcgtggttattggtaatctaggttatcaaacttggtgtcgacgttatccttggccagctgttcggtcgggtaaccgacttcttgtacctgaacgtggcccccttcgactagcaacagcacccgggtgtcttggccgttcaccttttcggtcgtcacgccgtagtagttgtggggtgcgttttattgcaaccaagaacgaacactaaagtactggataccgttatgggtaaaggcgttcccctccgaccaatccatcgacttaaactgcaggtcctggctcgggttttgcgggatttggtagtcggactgacgattgtaaaggaccgtggtgctggaggaaccgtcctcaatcgtcgtggttagctcgtggtcggtaattgtgaccttggtgacggactggttgtcgttgacgaagtaccaagtcccccgggtggcgcttggcgtcgcaaagtaaccgttacgcccatcggaagtcaggtcgctggtcgcgctactggaggcactgctactggagttggcgctagttgacgtactaccagaggtggcactcgtcccgttggcaatccggtcgaaggcgtcgcggacgctggcgttttgggtcggataaaagtccggaccgccgttagttgcttggtcaaccagggcgaccggctggccgtcgtggaaggcaaaggcgtaggtgatgtgcttggcgccggcgaagtcgtcatcgttgtagatggcgaccacgttgtaatcgtacttgcccttaccgcttggccgttgagttgccgccgcacccggccaagagaatggtcaggtctaacagcccggcaccgatccgtactttcttcatttgtttactcccctaactgatgatctttacaggagataattatgaatcatttatgaagaattctcaaactaaattttcgtttttatcaacccttttaatggcacaaaccgctaatgcaaacggttgacatagaatttcgccctcccagcacccatcaaattagctttagtttttctttacctttgactaatattatgcacgaacaagactcccggttgatcagaaccactaatcagaacggcgccgcttcgttaattaaaattattattaaaaccgctttaaaatttgctaattgcgcctacaattaagtcaaaggggggattaaagatgccaactaaatcgttatcgttagaagaaattgcccaagaagacgatcaaacccgcctcctgaccgaactacaaaccagtcgcaccggcctgaccaaggacgaagttacccgccgccaggcccaagacggccccaacgtcctcaaacaaattaagggcgcctcctggttaaccaaattcacccaaaacttcacctcgatgatggcgatcctgctctgggtcgccggggcgattgcctttgtcgcccaactcgaggaactggggattgccatctggctcgtcaacatcatcaacgggctcttttccttttggcaagaataccaggccggcaaggaaaccgacgccctgtccaagatgcttccttcctattcaagggtcgtgcgcgacggccacgaccaaaaggtactcaccagcgacctggtcgttggcgacatcgtcaagctcgaggagggcgataacgtggccgccgacatccggatccttgcggccacccaggtccaagtcgaccagtcggccttgactggcgaagtcaacccggtcaacaagggggcccaggccattgacccaaccggcaagaaccactttgagttcggcgacatcgtcttctccggcacctcgctggtcaaaggtaacctggtgggggtggtggtcaaaatcgggatggccaccgacttcggtaagatcgccgaactgacccagcaggtcaaggaagacatcagtcccctgcaaaaagagctcaacaccctgaccaagcaactctccgtgctggcggtttcgatcggcctgatcttctttttggtggcgaccctcttcgtccactacccgctggtcaaatcctttatcttcgccctcgggatgatcgtcgcctttatccccgagggactgtcgcccaccgtgaccctctccttagccggggcggtcaagcggatggcgcggcaaaacgccctggtcaaaaagctggccagcgttgaaactttgggagccgcttcggtgatctgttcggataaaaccgggaccttaacccaaaaccaaatgacggtgtcgagcctgtggacggtcgccaagcactaccaggtgaccggcgagggctacgaggccaagggcaaggtcgtcgatgggccccgccaggtcaacgaagagaccgacgccgatttgtacgagctcctgcgcggcggtttgttggccgataacgcccggctcgttccgcccgatgaccaccacccccgctacaccgtcttgggcgacccgaccgaggcctgcctggaagtggtcgccaaaaaggccggcctaaacgcccacgacgaacgccaagtcagcccccggcaacgggagctcccctttgattccgaacgcaagatgatgaccgtgatcgtcaaagcggaccccacccacccctttaacacctacaccaagggggcgcccaaccaggtcctcaagcactgcaccagctaccttaaccacggccaggtcctggcgctcaccgacgaagttagacaacaaatcgacgccgctaacgatggttacgcccgccgggggctgcgggtcctggcggtggcggcccgcacctatcagggggacccgagtgacgccacgatcgctaacgttgaaacggggctgaccttcatcggcctctccgtcatgttggacccgcccagaaaggaagtcgccgtggccgcccaactttgccaccgcgcccacataaagatcatcatgatgaccggtgactacagcctgaccgccgagagcatcgcccgccaaatcgggatcgtcctccccgaccaaccagtcacggtcatcaccggcgaccagctcaaaacaatggccaaggccgacctcaaacaagcgctcgccggccagataatcttcgcccggatggctccggaacaaaagtacgacgtcgtcaccaccctgcaggagatgggcgaggtcgtcgccgtcaccggggatggggtcaacgatgccccggccctcaagaaggccgacatcggggtcgccatgggtttaaccgggaccgatgtggccaagcaagctgccgacatgattttaaccgacgacaacttcgcttcgatcgtggcggcgattaaggaggggcgcggggtgtaccaagacatccgcaagttcttgttgtacatcctcaactccaacacccccgaagccgtcccgtcgctactcttcttgctgtccggcgggacgatcccgctcgctttgaccgtcatgcagatcctatcgattgacctgggaaccgacctgattccggccctcgggctggggaaggaggtcgccgaggccagcgttatggaccggccgccccgctccaaacaagagcatttgatcaccaagaacctcttgctcaaggccttcacctggtacgggctgttgagttcgctcctgtgcgtggccggcttcttctttgccaacgccattaacggtcacgccttcccggccctggccaccagcggctttgactaccgtcaggccaccacgatgaccttagcggtgatcatcttctgccagatcgcggccgtcttaaacatccgctatgaaacccaatcggtcttcaaccgccacttcttcgacaactcaatgatctttctcgggatcatctttgaagtcgtcctcttgttatgcctaacctacgtcccggtgttacaagacgtctttggcacggtgccactagggcccgctcagtggctgttcttactgtgcatcccgctgcccctgatcctgcttgacgaagggcgcaaatggttgattcgccaccactaattctatggaaacaaaaacggcccccaccacctggcgggagccgttatttaaatcttattcatcaatttcgtttgcctgactcttcgtttcggcagcggcgaagcgttcgtactcagcggccgcggcctggttgtcagccttcttcaagtggaagagggccttccagcagaccacgagcaggatgatgaccccggccgtgaagatcaggtcccatggcatccgtccccataagattaaagaaatcagcttttcgtggtaaaaggacatttgccgggcgtgccagtagccgtacttcagggcgtcggctaactggagttgcccgaccggcattagggtggcaaagaccatcccggctaagccgatgttcagcaaccaggcggaccagcgaatcgccttttccattttagccgtccagaattccttgactgtcacgttgcgtaacacgtacaggataatggcgatcgagaacatcccgtaaaccccggccatggaaccgtgcgcgtgggcagccgtccactgggtcccgtgttcaaagtagttgatggccggtgcgttgatcaaaaagcctagcgccccggcccccagggtgttccagatccccgtccacatcaagaagatgaaggtcgtcttatacgggaagttgtggtacgtgtcctggtaaacccggtagtgggtgtaggcttcccacactaacagggacagtggcacgatttcaagggcagaaaaagatgccccgagggccaaccatagggagtggtcccccatccagaagtagtggtgaccggttccgaccaccccggaaccaagcagcaggatcaattggaagtacagggcccgaatcgttgacctaatcgtggtcagcttcatatcaactaacagccaacccgttaaaataacggcaaaggcttcaaagatcccttctacccagaggtggacgatccaccagcgccagtaatcggcgaaggtgacgtgtgaatcgggcatgatgaaaatcgacgcgcagtaaaaggctggcacggcgatcgcccctaagaagagcatcgtgaccaggcgggtgcggctttggttatccttacggcgcatcgccgggacaaagccccgcattaacataacgatccacaggaccatggcggcgatcagcaggtactgccagaacttcccgagttccaggtactcccagcccccgttaccaaagagccaccagttcttgtttaagacgcccaagtcggtcaaccattccccgagcatgctgccgcccaccacaaagatgagcgcccaaaagaggacgtcgactaagatcccttgacgaaccggttcccggcgcaggacccggggcacgatatagattccggcccctagccaggtggtggccacccagaagatgaccaactggaggtgccaagagtgggccaggttaaacggccagatgttttggagcgcaatcccaaagaaggtgttttcgacgtagtagtgggccatcaattcacctaacaggatttggaccaagaagagcaccattaccagggcgaagtacttagccgtcttccgctgactggtggtgattggtaaggtatccggttcaatgatcgggacatccttttggtactgggccttggattcgaagttgtacttcttttgaacccagatggcgatcgccacccccattaccaagagggccacggagatccccgtccaagtcattgcctttggcgtcatgacgttgccggcttcgaggtcatacggccaattattggtgtatgagtaggaacgtcccggccggttggtggatgacaaccaagccccccagaagaagaaggcggtcagttggtcgaccttgttccccttgaccatgtattcgttggtgcggttcttgatcatgttatccggcaagccgacttgcttaggattgttgataaaggccttacggtagtacttaagcaggtactggtacccggccgtctgggccttggttaaggttaattccttatccttagcgttatagcggttaacccggatttcctctttaaccttccccttaattccctcttgttgcagggtggtcaacttattaaaggacttgccgtacagggttttggcgtagtaacggtacatcccttgcaagtaaacgtgtagcgcctgggccgtgtaatccggtcccaagtaagccccgtttcccaggtaggtcccgtagtcagccaactggtacttttcgtaggtcgcctgaccagagattagctgctgtttggaaaccagcgtggttcccgcttcggtcacaatctttgctggacggggtgcctcatttttaaaaatgagcaagcccccagcaattaagatggaaaagacgaccactagcgtcacgattaacgttcgcgacagccgccgatattgatcttgcatctcgcttcctccctaaaaataaatcaatattaatttacttaagattagctaaagtgtgacggcctgtcaactaattttggaatattttgatattcctcaattttagttttgtcttattgctccataacttgataacaatcaataaagttacgtccgacaattttcgttccttcttacttaaccatggtaataaaaagcgccccgcacctttataagagtgcgagacgctttttaattaggctataactatggggacgaattttgggtcacacactatttgtcaacgactttactttccacttccagaaaaccacacccgacaaatctaaaatttgacgcaatagacgccgattcgctaaatacggcctgtttgatcgattgggtcgcacttccgttttgcgcaaatctaaatatttgtcctgtgtctagctctaaatgggcataattaaaaaagcgagtcaggaatcaaatcctggctcgcttttaattttgcaatgttactcagataacgtgctccccaaccacgggtctagtggttgttccacactccggcgcagtacaccaatgggtttcagtcgcttaccaaggtaagcattcctgaaaccctattggtgcttgcgggggtgggacgacgaaattagaaatttctgtcccactccctattcccactcaatcgtggaaggcggcttggaggtcacatcgtagaggatccggttaacgtgatccacctcattgacaatccgcaccgagatcttttgcaagacatcccacggaatttgggcgaagtcggcggtcatcccgtcgattgaagtaacggcccgaatgccgaccgcttcgtcgtaggtccggccgtcacccatcaccccaacggagcggatgcccggcaggacggtgaagtattgccagatgctttcttgcaggccagccttcttgatttcttcgcgtaagatagcgtcactttcccggacgatttctagtttttcgggagtgacttcaccaagcacccggattcccaggcccggacccgggaatggttggcgccagaccaggtcgtgcggaatccccagcttttcacccagttgacgggtttcatccttgaacagggagcggagtggttcgatcagcttgaagcccatcttttccggcagccccccaacgttgtggtgcgacttgatcgtctgggcggtgtcggtcccggattcgatcacgtcggtgtacaaggtcccctgggctaagaaatcggcgtccttcatcttcttggcttcttcgtcaaagacggccacgaattccttaccgatcgtcttgcgcttttgttcagggtcgctaattcccttaagcttgcccaagaagcggtcggcggcgtcaaccttgataatgttaaccccgaggtcggcgcttaaggccttcatcacggagttggcttcgttcttacgcaacagaccgtggtcaacgaagatacaagtcagttggtcgccgatcgccttgtggatcaaaacggcggttacggaagaatccaccccaccggaaaggcccaggatgaccttcttgtcaccaacggtttggcgaatctcgtcgacttgcatgtcgatgaagtcgtccattgaccagttggccttggcgccacacacgtcaaaggcgaacttctttaagatgtccagcccgtattcggtgttacgcacttcggtgtggaattggagcccgtacagcttttcggcgttgttagccatcgctgaaatcgggcagttcttgctggtggcgaccacgtcaaagccggctggtacggcggtgacccggtccccatggctcatccaaacgtattccttctttggtaagcccgcaaacattacggcgtcgtctttagtcacttcaatgtcggcacgtccgtattcggaatcatcggcggcttccaccttcccgccaaggtcgtgagccatcaactgcatcccgtagcagatccccaaaatcggaatcccgagcttgtagattgccgggtccaccgtgaaggccccttcgtcgtacacactgttcggccccccggagaaaatgatccccttagggttgatctgcttgatttcttcggccgtaatcttgtgggataaaagttcggaataaatcccaaaatcacgaatccggcgggtgatcaattggttgtattgactcccgaagtcaagcactatgatcttgtcgaaggcgtcaagattaatgtttgccaaattttccactcctttatattatcttcaaacgtcctaaccattgtacgggtttcacccgggtgggtcaatggtgaagggccggtttcgcggattctttggcaaattaacgaagtgctccctagccatacggcctgccaaggaggttaggtcgcacttctttccttttatcctttcttaaggaaggataactttttggataaagttgggggggttctcgcccctccccggttaaatcgctacaattagttgatacctgaatcctttctaaaagcttgctataatgagatttaatttactaaaggaatgatcagtaatggatatttacgggacgaccaccccttacctgccccagctgctcgattttgtgatggaccgggtgcgcgacctctccaacaaggaggtcgccgccgaccgtcccaagctgtacgagcacctgatcgggcgggtcaaggcccaggctagtatggaagaaaaatgccgccgcaagggctacccggtcacgccggaatcggccctgacgaagtgtaaagacgcgattgggattcgggtcgtctgtaactttatcgacgacgtttaccgttcaattgaccggatcaaggccgccgactggtgcacggtcgtcgaagaaaaagactacatcgaaaacgccaagcctaacggttaccggtcctaccacttaattttagacgtgcccaccgacctccctgactacacgggccacgccccgagccactacttcgtcgaaatccagttgcgcacgattgcaatggattcgtgggcgtcattagaacacgaaatgaaatataaacaccacgtcaacgacccggaacggattgaaaaagaactccaccgttgtgccgaccagctggcctcttgtgacgtgcaaatgcaaacgatccgccagctgatcaacgaaagtaattaaggaggaaccgcccatgaacatcctgcttgcggaagacgaaaagcagctatcgcgcgccctagtgacggccatgcaggcgaccggctaccacgtcgacccggcttataacggtcaagaagccgtcgacttagccgggcaacgggcctacgacgtgatcatcttagacatcatgatgcccaagttaaacgggatcgaggccctaaagcagcttcgccaaaccggtaacaaaacctacgtgatcatgttaacggcgatggccgaaattgacgataaggtgactggcctagacgccggggccgatgactatctgaccaaacccttctccttaaaggaactcctagcccgcttacgatccctggaacggcgcagcgaggattatcaagaagacgtcttaaacttcgccgacatcaccttggataacgacgaacaacgcttggaaagccacaactcgatttccctatcaggcaaagaaaccaagctcttggcctacctgatgaaaaacccgggcaaagccattgaaagttcaatcctacttgaccaggggtgggataaagacgacgaggccgacgaaaccgacctttggatctacatctcctacctgcgtcaaaaactccaggccgtcaacgcccacgtgacgatcgttggtgaaaagggcggtccctttacccttagccagctagcttagggggtggcgacgatgattcaaaaattccggcgccgcttcatcgccatttctacttgcgccctcttcgtggtcctcttaaccatcatggggggcatgctgggggtctcttattacaaggcttcccaacaagtcaccaacgttttaaatgtcctcgctagccacgacggccaaatcgataaggatagcgtcacccaggtcaccgtccaaaaacgctttggtcccaacaccagtaaggaaagcctctttcagtaccgctacttttcggttttctttgacaaatccggtgacatcactaagatcgatagcggccacatcgccacggtcgaccaagacgcgattaccgacatggcgcactgggcttacaagcaaaagaaagcccgtggccataccgattacggcggtaccacctacgcctacaagctaaccaaaaagtctaacggtaaggtttcgatcatcttcttggatgaatcggtcatcatggcgtcagccaatgagttgatgaagatcgccgccaccatgggaattgtcagcctgctcctcttcaccctggttttgatcgccctttccaaccgggcgatccagccgatcattgaggccgaaaaacggcaaaaggaattcatcaccaacgccggccacgaattaaagaccccgctggcgatcatcgaaaccaacaccgagttatccgaaatgatcagcggtgaaaccgagtggacgaccagcaataagcaacaggtggcccggttgacccggttaatcaacaacctgatctccttagcccgcttcgatgagcaaccggaaatgacgatcgccaccatcgacgcctcggccgccgttcaacgggccgccgacagcttcgaggcgatgatcacccacgaagggaagggcttttccaccaacatcgccccaggcgttaaggtccgcgccgacgaaaactacttctacgagctgtgtaacatcttgctcgataacgccaataagtactgcgacgacggggggaaggtttcggtcttactacgggaaaacaaaaccacccgtgccgttaccctagaggtcggcaacacctatgcggagggcaaagcgattgattacaccaagttctttaaccgtttctaccgcgatgacacctcccacaattctaagaataggggctacgggattggcctgtcgatggcccaaaccctggttcacgcctttaagggcaagattagcgcccgctacaagaaccagaccctctacttcacgattcgcttgaagatgacgaagtagaagtgagtgcgaaccaacctcctcgacgggccgtatgtaagatcgggggaaggttgatgcggcacgcatcgttcttcacccgtacttagccactaggcccgtggttggtgagcacgttatcggaagtgcgactcaatctatcaaacaggccgtgggctaaggataggccacaggttagcacggcacgcggtgttctgtggtcagacttagccactaggcctgtgattggtgagcacgttatcagtactgcagcatagaaataaaagaccgaccggcgtttttaaacgctaggcggtctttgttttcacgtggaactaatcctcacgtaggtacacccgatcaatgtagtggtgctccgttttatgcaaaatcacgtcggcccgggtccgagtcggcaagatgtagtcgtttaagttcggtaagtcgacgtctttccaaacctgcttggccattttaaaggcctccgcccggtcgccctgggcgtacgggtaatagtagttggtcgggtcctgaaaggcggtgtctaacaacatcccgaaccgctctaggtaccacttctccactaggctggcgtcggcgtcgacgtagacggaaaagtcgaagaagtccgacacaaacaggcgctgggtggtcggtagttgcaagacgttgatcccctcgacgattaagatatcgggcttgtaaatcgtttggggatggtcctccatcacgtcgtaaaccgagtgtgaataggtcggcgccgttacctgatcctcgccggcgttgacgtcgttcataaaggtcaggagccggtccatgtcataggattccgggaaccccttgcgcgccatgatcccgcgccgttttaactcagcgttggggtacaaaaaaccgtcggtggtgatcatttcgatccgccggtctggcattaagcgcttgagcaagatctgaagcagccgggccgtggtgctcttgccaaccgctaccgaaccggcgatcccgatgatgtacgggatccggcgcgaggacttgcgcaagaaggtcatcttttgcaactgcatttgctggtagttttggtactggagttggatcagcttaatcaacggcaagtaaatgtcttggacgtcgcgcagtgaaatctggtcatttaaggacttaatctcgtccaggttttcctgggtcaagaaggtgatttcgctgggaaagaagctatgccaggtttggcggtcaaactgatcgtaattaatccattcgtccattatcatttctccgttcatttggatagcccttacattttaacacactcaagtaattacgtgcattcttggccaattctcggtaggatagactgccaaaaggggaaattgatttgtcactaacatccatcgccgttaccaaacgcctagccgactacccggccatccgggccctgtaccaacgggccttcccgcgcgccgaacaggttccctggttctggttgatgtttaaggctaagcgctcccgggcccacttcaccgcctattacgatggtgaggacctggttggcttcacctacttgatcgtcggccacaacgttaactacttaatgtacttagccgtcaacgaccggatccgctctaagggctacggtacccagattctgacccacttaaaggccacctacccggcccaaaccctcgtgcttgaaatcgagcaccctgaccccaaggcaactaacaccaagcaacggttcgcccggctacagttttaccttaaaaatcactttcaccaaacgccacacctggccgctgacgggccgatgacctaccaactgctggctaccgatcctaaggtcgaccccgccgtgatttaccgccaccacttccgctggtttgcctggccgctggggtggttgtacccggcgccaaaacagattaaataaattaagaagtggagaacaacaaaatcccgcagcagatcaaccaagcttggttaatttgctgcgggatttttcacttgaggttgggttgggtcacactcacaataacgtgctcccaaccacgggcctagtggctaagtacgggcggagaacggtgcgtaccgcaccaacccccaccctagcttagcccaacggcccgtcgaggaggccggttcgcactcactcttatacctgcttcggttggcccgtcgaaatctcaaagccggccgtcaccggtaaggtctcaccggtgatagcgctggcctcatcagtcgacaggaagtaaacggcgttggccacttcctctggttccacgatccggttgagcgggctgtttttggcaaaggtccccttcatgtcttgcgggaacatcggggtgttggttggacccggggccacgctgttgacgcggatctggtcctcaccgtagtcaatcgccatcgcccgggtcatgttgatgatggcccccttggtggcgttataggccaccatcccgtagtcaccacccatcccggaaacggacgagatgttaacaatggcgccgtgtcgttggtctagcatggtcggcaggaccgccttagccgctaggtagctccccttaacgttgatgtcaaagaccttcacccagtcgtcagcgctaatctcgtgaaccttgccatgaacgacaatccccgcgtcgttaactaaggcgtcaatgccgccgaagcgttccagcgttgccttagccatttccttagtgtctgcttccttggaaacgtcggcggccacaaagccgattaacttctcgtcaaagtcctgggtcaggtccgctacgacctgggcgcccttagtggcatttcttgcgactagcatgacctgccagccgttttgtaggaacttcttggtggtggccagcccaatcccggacgtggcccccgtgataacaactgtttgcataacaagacctccttagttgccaccattgtatacccaaaagtgcgcgagtggaaaataacctaactagcagtccacctgactaagctagcccggccgtacttaggcaccaggactgcggttagttcccacgaatagacaacaaaaggccgggaggaaaacgtgtttcccctcggccccttgccttggttttaaacggttattcagctaatccctagtggctaagtccgggcacagaacaccgctgccgcgctaacctgtgccctattttaactagttgggtcgcacttcttatttcgtcgggaacttcagggtcttgttggcaatttctggtgcgtcggtcgtgtaatcatcgaacaacgacttccaagcgttttccgccagcagactcgtcttcttcttttgttggaccttctttaagttggccaaactcttttgggcgttgtaagtgtaactagacttgttaaccttggtgaagcccggtagcttgtagaagcgtaggaggtcaccgttgattaccttgtcggataaggcgaggtcggtcgtgacgtacttttggatcttgtcgatctgcttcttttggctcgtcgtcatcttagtgatcggcttaccagtagcggtgtagtagtagtcaccaccgtacttggtgtaggtcttagatacccagtcgccatccctaaacggcacgatctggttgcgcttggtgctcaacaagtcctggccgaactggatgtacttgtccgaagagatcccgaggaggtcttcaatcgttggcaagacgtcgatttcacccccgtaggtgtggtcgatgccccccttgagtccttccatgttgatcatgaacggcaccttttggaacatggccaagtcgtagttagtaactgacttcttgcccaagatcttggcgatcgccgccttgtggttgtcggaaatcccgtagtggtccccgtacaagatcaggacggaattcttacgcaagccggtcttgtctaagtaattgagtagctccccgatcgattggtcgaggtagtgggcggtttgaacgtacggttcaaccgtgtcgtcacccgtcgacagcttcgggaagtcggtgtcttcgctgtggatgatgtacgggtagtggttcgtcaccgtaatcaacttagcgtagaacggttgcggcagctgttgtaagtattcggccgtgtacttcaagaacagcttatccttggtcccgtaaccgacgtcggaatccttaacggtcgggaagaagtctttagagaagaagtattggtagccaaatgacttgtaggcgttgtcccggttccagaaggatggcacgtccccgtggaaggcggccgtcgagtagccgagcttttgttccagcagggccggggccgcttggaaggtgttggtggtcccgtcaatcgtcatggccgaaccttctggcagaccaaagagcgagttttccaacatcatttcggcgtcggacgtttttccctgacctacttcgtggaagaagttgtcaaaggccaacgtgtcgctagagtggtagagcttgtttaagttgggcgttacttcttggccgtccaccttataatcgattacccactgctgaaggctttccaggtggatgatgaagatgtttttacccttcgccaccccttcgtattgaatgtttggtgacgcgtagttggacttcaagaacttctcgaccggggcgaggtccttggcactggccttggccttgatcgcactggtttgggtggccttgatcccatcgtaaatcgtgtaggcttccagccccaagtacttaacgatgtagttagagtcaaaagttcgggtcagaagctggctccggtcgctttcggccatcccgagattggcgccaaacaggacaaagcccaacgccgtaaaggtcgcggcgtagcgaattttaaagtagcgcatatcgacgcgaacaaagtggaagagcaagatgacgattaaaatcaccacgtccaagtagacacaaaagtcgcttggtttcatgatttcggccagactcttccccaggttattggaggtcgaccccgaccccttgatcacgttcatcgtgatgaagtcggaaaattcacggtaatagaggatgttggcaaacagccaggtggacaaaagcaggtccacgattaccatcacccaataggataaccgcccgcgaaagtataacccaatccccaagaagacgattgcgctggggatcgtgttaaaggcgagcaggaattgctgcaccgccccggtcgctcccagagtgaactttgtttggtacgcccagtaactcttgatcgcaaacaagagcaccgttaaaagaaagaacctgagcttggtattgaagaccgcccggacctttcgcagcgctgttttcataatttgtgttcctccatcaaaaatatcaacattctctatcatacaagaattccgggcattggcaattacttgaccatttttttcgtaaatgcttaagaatttcctatttcctgggaaatatttgaaaatagagcggtgccccgccgttgatcccgggaaattaaccatttaccaagccgctggccgggtgtatgatcattggcggactttataagagaaagaagaatatatacatgcaaatttcccaatcccgggccaacctgatgctggtcctcgttgccattttgtggggctcctcctacgtctttgctaagcaagttgtcgacgccggcatgcagtcggggctgatcaacggttgccggggcaccttttgcgttgccgccggttacctgctcttccacgccaagatcaaccagatgagccgccgcgacctcaagatcgggctgaccgccgggttgattaacttttccggctactacctgcaaacggccgccctgcgctacaccaccccggccaagaacgcttttttaacgaccatgtacgtggtgattgcccccttcatcctctggttattttggcaccaggccccgcggcgcaaggattacttcgccatcatcctagccgtgatcggcatggcgttgctgtccggaatctcctctgctaacttcaccctccagttgggcgacctcttgaccttaatctcagcgatcttttgggccctgcaattaatctactttgccaagttcgcctccacggtctcctcgccctggatcgtgatctttttgatcggactagtgcaggggagcctcggttgggtttgcgccctcttgtttgagcggccaagctttgcccacgtccactggctccaggcccttgttccgttagccatcctcgccatcgtggttaccttcttagcccaggggatgcaaatcaccgcccagcacttcaccacccccacggcggccgggatcatcctaatgctagaatcgctctttgcctctttgatgtcggtggcgctaggctttgaccgtctcaccccacaattagtcatcggcggggtaatcctaattttggccaacctgctcatgcaactcgacttggcgaagatgccgtttgtcaaaagaatttcatcgaattaaaaaggaccaggagaaatggaaatttcccctggccctttttgttgttggctgtcatgcataacttacggcctgctggacaggctgggtcgcactcacttcgtttggtacaattcccccggaatctggccaatcaggtccgtaaccgggcccacactggtcacggtcagggcgtgcatcgcccgtgaacaaatcgtgtagaccaactggcgttccgcgtcgccttggtacttagcctggttggcatcccaaacgatcacggcgtcaaactccagtcccttggctaagtaagacggtaccacgatcgtcccctgggccagccgttgattttcggtctgaatcagggtgaccgcttgcccggcctcctttagaagggcggtgatcttttcggcgtcggtcagcgtcttggtgatgatggcggtggtgtcgtgatcggcttggtacttcgctaaggttgccacaacttgattaacggcgtcctcttcacttggcgccgtcagcacccgcggcagttccccttcccgttcaaaggcctcaatagcttccccgtcctttaggatcgccttagtaaagttggtgatctgcttggtcgaccggtaggaacgggtcagctgaatgaccttggtcttttccggttcaaacatcgtgcccaactgttgcaagaggctccgggcgttgttgtgggtgaaaatggcttggtttaagtcacctagcagggtgaagcgggccttggggaagcagaacttgaggtaggccagctggaaggcgtcgtaatcttggacctcgtcgacaaagacgaagcggatctcgcgttggccccgcttaccggtcaagagatcgtataagtacaggtagacgctgattccgttggcgctcatccgcttttccttgagggccgctaactgatcgtcaacgtagctcgcccattcgtcttcggtcaggccaaagtcggctaacttcactagcttcggagtcacccggagtaggtggatgtattgggcgttgatgttcatccagcggttatggtcaatcgcctttttaatcggcttgaaggcctccattacgatccggcgggccaggtatttgttttcggcctcttcgtccttaaactcgccaccgtactcgtggtaaatgacgtcgagctcttccttgcttagggtctggatccgttcttcgacccacttggagcgcatctcaccagaaatgcgccggttgagcatcttaagcagctcctgcttggtagcgtccagccggttccccaggttgtagttttggttaaatgagtagtagagctcggcgatcttgtccttgctaaagaaggccttcttattaaacatcaggttcttaaagcgtaggtggccatcgcggcctaaccgcttggcgtagcgagtaacggcgttaaagtaggtcaggctggttaacagttgactggcccgggcgttgaccccctcctggtcggcgtcgaagcgttcctggattgaggcgacttgtaagcgcggcacccgacggttaacgtactggtagtaggtcagctgcaccatgttgtgttcccccagttccgggagcacctggtcgatgtagtcgttaaagagctggttggggctaaacaagataacctgcgaggaattgaggttgccccggtagcggtacaagagccaagcgacccgctgcaagacggccgccgtcttcccactcccagccgccccctgcacgaataacaggtcggcgtcggtgttacgaatgatccggttttgggtccgctggatggtggtgacgatgctcttcatcttggtcgacgagtggttgtttaaggccgccaagagcatttggtcggtcaccgtttcggccgtatcgtagagggtcacgattacgccgtcttcaatttggaactggcgctttaacttcacattgacggtctgttggccatcgggggtgtcgtaggaaacctcgcccagttcgccctcgtaataaattgaagagatcggcgcccgccagtcgtacaccaaaaagtggtccggcgagtcggcaaaggaggccaggccgatgtaaatcgtttccggggtctggccagcttcttcggtgaaatcaatccgggcaaagtagggcttggcctcgaggcgccggaaggtccctaggcggtcggcggcgtgttgccaggagttttcccgctcatcgaggagctgctgttgggcgcgcaccgacatcgccgtgtccatcatccccgagtaggtggtggtattcatgcggatctcgttgaagtccccgctaatcgtatcgatgtcttttttagcggactggatcttttggcttgcctcttgttcggcggccttaatccggtcaatcacctggtccaagtgggcctgttcacgtgcttgggttgcgtcagtcaaatcgatcgctcctttttgcgtaaaatcaatctaattattatagcacgatcagcaatccctttccgctccaacgctcttcaattttggtaaagcttttggtattaatgattaaattattcgccctaaccatcatttccccctaaaataagggtattagaactttagaaaggaagccttccctcatgctcagccaactcacctatgggctcacccacattccggaagtcatcattccgctctttcaatccgtcggtaactgggggtacctgtgtctctttttgatcacctttatggaaactggtttggtcgttttcccctggctgcccggcgagtccttgatttttgtggcgacctcgctatcggccgtttcgaccaaccaaatccacattgaaatcttgttgccgggcttttttatcgccgccttgctgggtgatacggtcaattacttgatcggcacccggctaatcaagctcccctggctcttcaaacgcctggatggccctaacctggagcgagcgcggatcttctttcaacgccacggcattaaatcggtcatcttcggccgcttcgtccccctgattcgaacctttgtccccctaatcgccgggtcctcgggcctcaaagcccgccgctttttgatcggtaacttaatcggcagcgccctgtgggtcttgttagccggggtggccggctactacttcggcacgattagtttcgtcaaggaccaattctccctggttttactagggctaatctgcgtctcctttttgccggccgccatcgtctgggggatcaatcgcttacgccgccacatcatcatgaaaaagggctccttttaaaaccctcggttccgcatttcataatgttttctggtatacttacaattaaatgttaggcaccccaaggcgctccgccggcgggtgccaactgttaattcgttacgattgtgagggagaaaaatttatggcaattaacgtctactttgttcgccacggccaaacctacttgaacctctaccaccggatgcaagggtggtccgattcaccgctgaccgaaaaggggctggctgatgccgcccgggccggtcaagccttagccaaggttgactttgactacgccttttcttcggacctgaagcggacgatggaaacggcgcacgaactgttagccaaccacccgggtaagctaaccgacgccaccccagacccggcttggcgcgaagaattctttggctactttgaagggctcaattccgatgccacctcctacacggtgtcacgggaattccggacctttgaagaaatgatcgccaactacggtgtcgaagctacccgcaacaagattgcggccgccgacccgttcgaacaagccgaagacgacgacgccttttggaagcggttggaaccgggctttgaaaccctacgccaactaccggacggctccaacgtcctcgtggtttcccacgggatgacgatccgctccatcggtagtcgccttggcggggcagagtacactgcccaaccgcaaaacggcgcgctggccaagctggtcttggaccaagacggcgcccacttcgccttttacaatcaactccaggttcctgaatagatagggggaaacttcacctcaatggataccaccgttcccagtgaaaaagtgattatcattggcttaaacaccggccaggccaactacgagtactcaatgttagagctggccgaactggcccaagccaaccacatggaagtcatcgaccgcctcgaccagtccctcgaccggcccaacgccgctacctactttggtaaggggaaggttgaggaactgacccagtttgctacggccgagcaagccaccacgatcatcgctaacgacgagctgacgcccagtcagttagccaacctaaccgaagccaccaaaatccgggtgatcgacaggaccgccctaattttggagatctttgcccaacgtgcccagagccgggaagccaagatccaggttcaaattgcccagcttcagtaccgcctgccgcgcctacacacggcggccaaccagtccttagaccaacaaaccggtgggggggctgggtttgccaaccgggggtccggggaaacccagatcgaaatggaccgccgggtgatccaaaagcaaatcgcccacctacgcaacgaactcaaggaaatcgccaagtccgaagaaaccaagcgggccaaacgggaccgggatacgatccccacggcggccttagtcggctacaccaacgccggtaagtcgacgatcatgaaccagctggtggaacgcttcggggtctcgtccgaaaagaaagtctttgaaaaggacatgctctttgccaccttagacacctcggtgcgccaactaaccctgccggaccaaaagcgcttcttgctttccgacacggtcggtttcgtttctaaactgccgacccacctgatcgaagcctttaaatcaaccttagccgaagctgccagcgccgacctcttgatccaggtgatcgattactctgatccccaccacgaggaaatgatggcgacgaccgatgaaaccctgcgccaaattgggatcgaaaacatcccgatggtctacgtctttaacaaggccgacaagaccgaggtgtccttcccgaccatggagggtgaagaccgggtcatcgtttcggctaagcaggacagttccatcgacctgatcgtcaaggtcatccgccagcacctctttaaggactaccaggaggccaccctgttggtgccgtttgccgacggtcacgtggtttcctacctcaatgaacacaccaacatcttggacaccgactacctaccggacggtaccaagctacggttagagatcgcccctgaggacctgcaccggttccaaaagtacttgctgacggaataaaggaagtgggaaataaccttctcgacagaccgtatgactaagctagggagaaggttggtgccttggcaccgttcttcgcccgtacttaggcactaggtctgtggtcattttccacgttatcagtgagtgtgacccagccattaacaggtcgttagggataatattaaatataaccagggccgggagagcacgtctcccggcctttttaggaagtgttaacatgcaaattgttcaagccaccctctatcgcctttctttgcccctcaaacaccccttcacgactagctttgggcaactgggcgccaagcagtgtttgatcttagaactagttgacgagttaggccaccacggctttggcgagggggccgcctttgaggttcccttttacaccccggaattcttagacggcgactgggccctgttagagcgccaactcctcccccgcctcttaaagacgcccctggcccatcccgatgacggtgacgccctgttttcctacgtccgccacaacgaaatggcccgcgccgccatcaactgcgccctgtgggacctctttacccagcgaaccggccagtctctagcccaggcgatcggcggtaccaagacccaagtcgaggccggcgtcagcatcggcatccaaccctccccagcggaactggtgactaaggtgggcgactacctggcggccggctaccggcggatcaagatgaagatccagccggggcatgactacgattacctgcgggcggttagggaggcctacccgaacgcgatgctgatggccgacgccaattcggcctaccggctcagcgacctccccctgctaaaacggcttgacgacctccacttaaccatgatcgagcaacccttaggcgccgatgacctagtcgaacacgccgccctccaagccgaactggcgaccgccctgtgcctagacgagagtatcaactccttagcagacgccgccacgatggctaagctgggcagcggccggatcattaacgttaaggtcgcccgggtgggaggactgagcgccgccaaacggatccaggactttgccagccagcacggcttagaatgctggtgcgggggaatgttagccaccgggatcgggcgggcctttgacctggccgttgccaccctccccggcttcaccctccctaacgacatttcagccgccgcacgctactttgaccaagacatcaccaccccgccggttaccctaaatggggccataattgacgtgccgacccaagttgggctgggatttgaagtcgaccaggcagccctggccaagttcacaacccaaaccgttcaagttaaccgataacgctaaaaggcgcccgcccgttcgtagttcgaactaggctggcgcctttttagatctgcaattactttccggccccaccttcgttatcggcctccccgctcgaccacaccttcgtggcgtagaccgagttgaacaggagggccgcttgcagggccacctgcgataagttggcccccaaggaaccaatgtgggtcgccccagtcatcacttggacggctaagatcccccagtagatgatgttcgccaagttgacaacgatccatagtgaccaattttcctcaaacttgaggatgtaaagaatttgggcgatgaaggaaacgacgaagttaatcgaatcaaagtagggtagctggccgtgaacggtcgctaagatccaccaaccgatcgcccaggccacaaaggcaccgccaaagattaagccccgggtgcggctcgagaagcgcttggtggcttcgtcgtggccccacatgaaccagccgattggttgtgagataacgtagaagatgtcaatggcaaaggaaccgtaggcgtgcgagatccaagcgacgtaggtcatcgctaggcactgaatcaccccgaagataaaggaaatcttgcgccccttcattccgtagaccaaacacaaggtcccaaagacccccgacaccatcccgatcacgctatccggtgcgattagataaacgagcacctgtagggcgatgaggacgctaacgtagataacctcaaacttcttccagttggtaaagagctggttataccaccagccgtggcgtgcgttttccatggtttccctcctcaaaataaccataatgatattaaaaccatcataagcggggtgccggagggtgacaagccccaattaaaaatgggattggaaaattttccaatcccataacgtgctccccaaccacgggcctagtgtctaagcaggatgaagaacgccacgttccgtgacaaccttcatcccagcttagccaaacggcccgtcgaggaggttggtccgcactcactaagataacgtgctcctcagccgcaggcctagtgtctaagtacgggcaaagaacggtgctggcgcaccaaccatttgccctagcttagcccacggcctgctttaatggctgggtcgcacttcctattgctcatcaatcaccacgtcttcgttgaccttggcggcctcctttaggtctggcccgtcaatccgcgaggcaatcgcccagcggtaaacgattaaggacaagatcgtgatcaccacgaagtcatacgggtactcgatcaaaccggtcccgccaaagcccttgctcccgacgtaggaaagcaccgacagggtgaccaggtaaaagagcatccataaggaccccttcagttgcgtccggagcggcacgtggtcgtatttaacttggtagtaggcgtaaattggtaaccccaaaacaaccacgaagatcacttcgacggtcgttggccacatcgcccagtaaatgaccatgctggtcaagacaaaggataagggggcgacccaagacagggccttggagttgaagggccgggtgaagttaggccgcatcttgcgcagggaaacggcggttaccggcccggtggcgtaggccacgaaggttgaaaccgaaacgaccgtcgccagcttggaccagtcgcggaagaagaagaccagcaccatcgccaagaccaagtcggccaccatggcaaagcgcggaatcatgtagcggcggtttaaacgtcccagccaggctgggatgttgccgttgcgcgtcatcgccgctaacgtccgcgccgaggtggccacgaaggtcaccccggtcccaaacggcgaaacgaaggcgtccatgtacaagaggattgacagccaggtcaatcctaacagaatcgccaagtcggcaaagggcgaggagaaattaatcccctgccagcccaccttcgccaaggtggttgggtcgaccgccccgatgaaggcgacctgcagggcgatgtaaatcaccgccgtaatcgtcagggagatccacaccccgcggaagatatttttttgcgggttcaccatttcaccggccatgttgatgacggtttggaaggcgtcgtaagagaggatgatcccagaaacggtcaccgcctcaaagatcccgcgggtcccgtttggcatgaaggtcgcggtgctgtggccgaagttccccgggtgaaagccgaccacgatcaaggtcacgatcgtcaaggtcgggatgactaatttaaagaccccgactaaggaggtaaagcgggtcaacaccttgaccgaccagaagttgattagggtaaagaccagcatgaagacgtacacgaccaagagcccctcggtcgtgattgccccatcgtgcataaagttggccgtccagttggcccacttccacggccaaccagccatgtattggacacaggcaactgcttcgatcgggatcagggtgatcaaagagacccagttggcccaggcagctaagaaccccagtaagggcccgtggctgtactgatcaaagcggctcattcccccgctttcgggaaacatggtccccaattcaacgtagttaaaggcgatcaggatcatgatcgccgcccctattacccaggaaataatggcggccggaccagcaaccttggcggccgtccccgaaccaaacagccagccagagccgatcagagacgatagcgccagcatcaccccggaaaagaggctaatcttattttttggcatgattactccattcaaatgattagtgatagagaatagtatagcacagctcagcgcaagcaaacttaaaagcaaaaggtgtgacggaattagcgatttatcaaaaaggaaagcgaattgtggttccattaccagtctaaaaaaacgtcctcagcatcaaaagtgaggacgtttttttagatttctttttctaaaatcggacaaatacgatccaattcatcacgtccttaaaagaacgtgtttccttgcccgctttcaaaaaaagcccccagcatctgccggaagccttagtagtgcggcgaagaggactcgaacctccacggtctcaatgaccacaagatccttaatcttgcgcgtctgccagttccgccaccgccgcgtcaacaagaagtactatacccgcatcagtgaatcgatgcaagccccttttgaatttttttgacaagggtggcgattaatgtcaatctagtagggagaaaagggggagaatagtttgaacgaacaccgatcgacgacgggccgcccggggatttccttaccccaccaagagggggacattggtgacttcttgaaggtctttgcctgcacggcggtgatggtccagccattgcttgcccaactggtgagactttcgactgggccaacgcagcttggcctagcgatcttggataacctggttaagtacacggcacccgccttcatctttggcatcttgtacacgaccatccgtacccatagcggcgccggcgtttttaattaccgccactacctgcgccaacagtgggcggcacttttttggcccaccatatactggaccagcgcctacttacttttattacccaagctccaacaagagcaacactaccataattggaccagtttcgcctggcaattcgtgaacggtaacgcggcgccccacctttggtataacacgatgatgctccagttcatcatcttgatgccctgtttttgggccctccaccgcttggttgggaaacgtccgcagcgggggtgggtagtggctatcggtaccgccttaattacgctagcctggttggctttgtaccaacacctagtgggccagaaccccagccattggtatttgctcgaccgggtctgggtgagctttttaatttatgcggtggacgggatattattagttaacttccggcgccctttgcttaacgctttactgcgcttttggccacaagcagcggtcttcaccattgctagcctcgcctggatgatcgtccaaatgagaggcgagtgggccaatttaagcgtcgtcagttactacaagctttccgccactctctacgccctcggggtcatcagcttagtgaccatttggtgggtggtgaaccaatttggccagtggcgggggaacctgcggattatgcacggggtggcaacgtatgcctaccgcgcttacctaggcaatgtcttttggcagaccttgctttgggattggtggggtcgtcaattagccaccacgcacccatggttagcgttggcgctcctctggccggctacctggttgttagcgtttggttttgcctacctgttacacctgatatgggggcgccggccgattaaacaaaaatgattcaagaaccactaattgattgaaagcgtttaattatctggtttggaagggaataattaaaatagaccacttgacgaatcgaccaaagaccgttatggtgagggtagtttagttgcctagccagaatcgttggagggattatgctcaatcttaatacaactgccgcccaggatccccaagaagtggcccgcttagacgccaccacccagcgccagctaaacgccaacgccgcggtgctcgtgcgggggctgcgccaggacctggacatgacaacgggagaatttgcgacatacgtaggcttaacgccaactttaatttcgtctattgaagaggttcagattaacgtctcctacgccctggtggccgacatcgcacaccgggcgggaaaacggcttaacattgagtatcggtgatttaagagagtgatagcaagggactgggaaaagagctgtttttccggtcccttttttatatacatttaacgataacgacataaagttatatcccagatgtgtcgataacgtcataaaaaggagagatatcatggcacaattaagccacatggataagcaatttaagaccctcgctgactttttggggacccactttatttacacctacgataacggctgggaatacgaatggtacgctaaaaacgaccacaccgttgactaccggattcacggtgggatggtcgccggccgctgggtgaaggaccaagaagcccacattgatatgctgactgaaggagtatacaaggttgcttggacggaatcgactgggaccgacgtggccttggactttgttccaaacgagcacaagctcaacgggacgatcttctttcccaagtgggtccaagagcacccggaaatcacggtttgtttccaaaacgagcacattgatttaatgcacgaaagccgggaaaagtacgcgacctacccgaaactggtggtgccagaatttgccaccattacttacatgggggatgcgggccaggataatgatgaagtcatcaacgaagccccgtacgaagggatgaccgacgacatccgtaacggtaacttctttgaccaaaactaccgtcgtcaaaaatagcaaaataagaggaggtcagggaaaaaacgatttttcccggcctcctctttggtataatgtcgttaattaacggggaagggaagtgatgggggtgcccgccaaacgaattttaccctacgtcatcttagggatcattgaagaacatggccagctatccggcaaggatatcaccaaggaatttacgaccgacattggggagttttggaagtcctcgcacagccaaatctacccggaactgcggcggatgaccaccgaccattggctggccgtggtcccggacccggataacgataaggaaatccactaccaactaactacggaggggcgccggattttaaaccagtggttacaaacgccgaatcaggctttgccggtgtccaaggaccttttttcgctcaagatgtttttcattaaggaccaagacgacccgcggatggccgtgctgattgaaaaccaacgccgcttggtggaagcaagcctggcccacttaaacgaacgtaagaagcggctgtttagttcgccccaagcgattcgggaaagttacggccactacctgattctggagcgggcaatcagccgccagcaggctcaattgcagtggctagcggggttgaccccgccaaagaaaggatgatgacgatggcagaagaatggaccctagtattagttaagccggacggtgtcaaaaaccgccacgtgggcgaagtgatcactagaattgaacgcaagggctaccagattattgacttaaagatgattgagcctaccgaaaacaagttacgccaacattacgccgataaggtcaacgagccctactttgctgggttaatgtcttacatgaccgaggggccaatcgtgggcatcatcgtggcggggaccaacgtggtcaaggccattcaccggatggcaggggccaccaatcccgttgaggcagcctgggggactatccggggcgactttggccgcgaatggccggacggtaacttgcgcaacgtcgttcatacctctgacaacccggccaatgcgaagcgggaaatcgagatttggtttccggagcgaaccgtggttgatcaataggatgaacaacctaagattagtttagagtgaaaacataataaggggctgagagaatggcgtgtctctcggccccttaatatttgctggtgattctattttgtagctgcttctacccgccgttggtgaacaaagcgggttaaaagtaagatgatgacgattaagacaacgatgacgagtaagcgggtgtagtttcccttaaacaaggcgtcgcccccaaaggcgtagagggccgaagttgggaacatccccacggccaccatcaggatgaagttcttacgggggattttcatcgtcgcgcaggcgtagttaactagcaccgacgggatgatggggaccatgtaccccactgtcaaccctagggcgggatggcggtagtgggttaagctgtccaaaatcttgttttgcttaaatttatgggagagtttgacgtgcgataacagggcggcgacggcacaattgcccaaaatattccccgcccagttaaccaagagaccgatccacgggccgtaacagagaccgacaaaaacgcaaataacggcgttggagaggcccggaatcgcgttcattacccccacctaggagtaacatgaagatcaggtcgcgaataccgttgctgcgaatcatggttaagagctcggcccggtgagagggggtcaggtccattaggaggcgaatttcaggcatgaagtcgtgcacgagggccaacaccaagaggatgatggcgatcacgcccggcccaattagccagtacttatttaaacggtggttttccatgaactattttctttctaagttgctggcgtagatggtggccagggtgtggttgagcagggggtcgtgggcgtacaggtaggtgccgcggacgcctcgctttaggatgacgtttaacgcgtttaggatcagacgttcctggtagtgcttaacctctgctgggtcggtaaggtcgtcccgacgcttgaaggcctcactgtcggtgaagcggtccaagttgacctggaggcggttagtaccgggaacttgggcaatcaccggcccgatgatgatcccggcgtaattaagatcaaagccttggcaagtgtagatcgaccccacttcattgatggtgctggggatttctgcccaaggcgtggcggtgtaattgtactggtcccagggcatcttgaagcgtccctcttggatgtagtgcttacccccatctaaagtggaggggtaccccgaggttgacagaatccgggagaggccgaccgccgcgtcctgtttaaagacctgttggcgcattttctcagcgtctgtaaagacccggaagtcgtagtggtcgcgggcatcggcgggcaaggggttaataacgccgtcggtgaagtcgttcatccactgcaagagactggttgaggcgctcatccgaaactggtgggttaaggtaacttcttggtgaggatagcggtgagtgatctgttccaaacggtccctagtccaaaagctcttcattcgcaatacctggtaggggtcaaagactaagattaccacccgggcccgcttaatgatttctgctaactggttttcgtggtagaagttattgtagtgatcgggcttggacaagaggagatgggcctcgtcaacgaccaccacgtcgacagtttggtgctgcttatccagctggttgataaacgaggtgggccgcatgaagttcttcttgagtagggcggcctggtcgcctgcaatttccttataaacctttaaaacctccgggtgattaaccaaaaagtaattggtggtcttaaagagggggctggtttgatcattacgcgtccttacctggagctcattaaagaggtgggataagaccacgcttttaccggtaccggcctcaccgtaaatggtaaaaacggccggagccgtcccggtcaggtgctggttggtaaagttaagaatttggtggaggagttgttcttgttccggtgtgaggggtaacaagggggataacttagccaccgcttggttggtatcagtttgcataggggacgtccttaaacatttctttatgtttaccatggtactgattctgccggggagcgtcaaacgatcgggctaaattatccccggtggttgataaaatggtgtaaaataatgaatgtaaattatcgacgcatatcaaattaaggggtgtttaataacatgaacctgcatccagattacctgttaaacgaagtcaacgaacccgaagacatcaaggggatgactctccaacagcttcaacagttggcaacggaaatgcggaccctcgtcttggaacgcgacgaaaagattggcggtcacgtcggtccaaacctgggcaccatggagctgacgattgccctccactacgtctttgattctccacacgacaaggtgatttgggacgtctcccaccaaagctacgcccacaagatgctgaccggacgtaagctgggctttttagatccggaccactacgaagacgtcaccgggtacacaagccctgaggaaagcgatcacgacctgtttgaagttggtcacacctccacttccattgccttggcagtgggtgaggccgaagctcgcgacttgcaagacccgcagtccaaagacgacgtaattgccgtgatcggggatggctccttatccggtgggttagcctttgagggactgaacaacgccaccaaggttaagggaaacttgatcatcgtcgttaacgataacgaaatgtcgatcgacgaaaaccaaggggggctttaccaagggctcaaggaactgcgcgcatcaaatggtcaagcagcgaacaacatcttcacctttatgggccttgattaccgctacgtagaagacggtaatgacttagccaccatgatcgaagcctttcggggtgtcaaagacgttgaccacccagttgttttacacgtccataccctgaagggaaagggctttaagccggcggaagaggaaaaaatgcgctatcactggcgcagccccttcaatccaaagacgggtgcagaccttcaaccagccccaaaggaaacctactccggcgccattattgatgaattagaacgtttaattgaagccggtaccccaattgcggccattaacgccgctatcccgggagcctttgacctcaagcgcttcgaaaagaagtacccggaccgctactttgacgtgggaatcgccgaacaaatgtcggtttcttcggccgtagcgatggcccaagccgggatccgaccggtactgtttgaaaactcgaccttcttacaacgggcgtacgaccagttaatccacgatatggccctcaacggggaaccggtcgtgatgatcgttcgcaacgggtccattaaggaaaactccgccacccaccaaggctcctttgacattgcttacctgtcgagcctgccaaacgttgattacctagccccaaccagcgtggaagagctaatctcaatgcttgactgggcactgacccaggccgaaaacccggtcatcatccgccaaccagagcaaaagctgctccaccggccggccacccaggataactacgacacgatcgattacgaaatcgcccaccaggggagcgaagtagcgatcatggccgtggggggcttctgggaactaggtgaagaggtccttgcccaactcaagagcaagctcaacatcgatgccaccctgatcaacccgaaggcggtcaccaacatcgaccaacaagacctccactacttgcaagaagatcacgatctggtggtcaccttggaggacgggatggttgccggcggttttggcgaaacgatttcgcgctactacggaccaaccaacatgaaggtgctcaactttggttcccagcgtgaatttgccgataacataccgcttgacgtcatgtacgagtggtaccacttgacccctgaacaaatcgttgacgacattgaacgggtcttgcactcaagtttataaaatattgaaagaggtctggagaaagctgtttctctgggcctcttgttgtattcacgaatgttagacagataacgtactcctccctagcttagccatacgacccgaattggaggttggtcgcacttctaataacgtgctctccaaccacaggcctagtggctaagtctgaccggagaacgatgcgtaccgcatcaacccccgttctatccttagcccacggtctgcctgatggctggatcgcactctccctttttcgtcatttcctccccttttcccgtacttagttagtgagaccaactacgggaggaacaaaccatgtcatttaaattccaagcactggggctggccctcactagcggctgcctcttaaccactgccaccaccatcaccactagggaacccctggcgccagccagtaaatcgccagccatagcggtgcaggccgttaaaccggagtcggaggtggccaaaggggtggttaacagtccggcgccccaattaagttcacgggtagcaacaccaagtagtgcgtcaacgccaagctcgtcagccagttctgcccccactagtgctccggctttttcaactagtactactagttcagtcagcgaggttactaagggtgaggaggagacgacgccaagcaccgcggtatcaaaggcgagcgccgttaccgtggcgagtgccgccccgatgcaaccgcaagccaatcagccagaacaggaacctaccagcgccgcgacttcaagtgggaccagcgagaatgaagcggcgttggcaagtgatagttcggctagtcaggtggcagggagtttggtttcttcgtcggccgccagtgatgagcaggcaccttcgtcaaacacagccgccgttagccaaccgagtggtagtaggtctaccgaagcatccgttacaagtgcggccacttcctcgtcaccggtggtcgcaagctcgtcagtaaccgaaagtgctactagttccagtggggcggcaacgaattcgacaaaggaagggcgcccggtgaacgcagggaccgttgaccaagtactcgccaacatcctgggtaaaaaggcggcaagctcatcaagcgcccccgctgacgaacggagtggggatcaccaagccttaaaaaggggcggtgcttcgtccaccaacactccccaacgccaactcccccaaactggtaatcagggaacgggcctgaccatcgccgggctaggtttatttgcaatggttggtagcgcccttaaacggagttgggtgagccaaaaagtttaaggaattcacatgattagcttgcaatcgcttagttctaatggtaatctaataaacatattaaagacctgcaaggaggagccaacatgattaagcaattatccaacgttatcgttactagctccacctcaaccacaacaacaacgcttgttggttgagggattttgacatggtctaattagcagtcaaaaataccaggtccgctcaaccaccaacatcccttcggtgtttaatgagcgggcctggtttatttttacctggaaatgaggaatgcggaatggataagaaacctgaactagagcggtcgatgacgccgggtcagatggaaatgattgccatcgggggaacgattggctcggggctatttatgggggccacgtcaacgattaagtggaccgggccctcggtcctattagcctacgcctttgtcggaatggttctgtacggggtcatgcgggcccttggggaaatggtttacctgacgccggggaccgggtcgtttgccgactacgggtcgaagtacattcacccggtggttggttacctggtgaagtggagcaacgtcttccagtttattatcgttgggatctccgacatcatcgcaatgtcgcagtacctaaattactggtggcccaacctgccagactgggtgtcgggaatcgtgatggtcgccatcttaacggcggccaacctggccagtgccaaggcctacgggcgcctggaattctggtttgccatgattaaggtggtcacgatcatcgtcatgatcatcttagggttaatggtgattgtgctgggattcgggaaccactggcacccagttgggatctctaacttgtggagccacggcggcttcttcaccggcgggtggatgggcttcatgttctccctgtccgtgatcgccgggtcctaccaagggatcgaattgttggggattacggctggtgaatcctcttcaccaaagcacgcgattgttaagtccgtcaagtccgttatctggcggatcctgatcttctacattggggccatcttcgtgatcgtttcgatctacccgtggaaccaattgagctcggttggctcaccgttcgtggaaacctttactaaggttgggatcaccggggccgctgggatcatcaacttcgtcgtcttaacggccgccctttccggggccaactccgggatctactcggcttcacggatgttgtttaagctctcggttgacggggaagtttccaaggtcttctccaagctgtccaagcgggtggtgccaaacgtggcgatcctgacgatttccggttggatctccgttggcttcatcgttaactttatcctctccgccgtatctgccaagacgcaaaaccttttcgtgatcgtgtactcctcctccgttttaccggggatggtaccgtggtttgtcatcttgatgtcggaattaaacttccgcaagcaacacccggaagccttgagggagcacccgtttaagatgccgctcttcccggcttacaactacttctccttaatcgccttactgttgatcttgatctttatgttctttaacccagatacgcgggtttccgttgccgtaggggtcatcttcttagcactgatgacggcaatctacttcagtacggtgcacaaacgtaagcaagctcaggctgaataaaggagcaatgccgttattaaattcaaggatgtgggaaagttacgctttccccatccttttttattccatggaattagctttaaaccgaaatttggtgcttccttggtaaagagagtaaaatgaaccataataattccaatgaagggggccttgaaatggctagctacaatcaaacacttgccatgcgctacaaccgacagggggaggaggccgtcgttgatgggcatctccacttagcgatcaagtactttacggacgccatcgccctctggccaaacgccgagtcctttggcaaccgggcctttgcctttttagagagcggggatagccggccggagtggcgaatggccgtcgacgactttttagtggccgccgtgattgcctttgacgattactggggcgaagaagagagtgggtatttaaccaaccgggaacgtcgcgattacgccgattacattgagcggttcttagccggcgctagctacaccagcctctttttaacgctgccgccaatggacgaggaaacccgtagttatttccgcctttgctttttggcgatgctcaactactacgatttctatgaagccctgcaagaagagcaggtggccaacgaccgcttcgctagcttcattaactcacttgaggagcacgactttgatcgcgaaatggagatcaacaccgcccagattattcctaattaccggcaaatccttggcgattcccagcgggccggtcaatacttgaagaattcccgtcgcgaagacgcccgcatcttagcggaccgaaagatcggtcaactctttgatatgatgcaagaaatgctacgccgcaccaaaaaggaggaattctaatgccctgcaccacaattttggttggtaaagacgccagtctcgatcacgccccgttaatcgcccgtcaagaagattacggtaacgcctttaacccccagtcctttcgggtaattttaccccaggaccaaccccgccactacgcttctaagaccaccgacttcatctgtgatttaccggaaaacccgttacgctacacgtccactcctgacgtcgatagtagcgccggtgtctttgcggcggggggaatcaatcaggccaacgtggcaatgacggcgaccgaatcatcgaccaccaactcgcgtatcttagggctcgacccctttaaccaggaaagcgggattggtgaagaggacttcgtgaccctggtcctcccgtacgttcaatcggcacgcgaaggggtagagcgactgggtcagttgttagaacaatacgggacctacgaagccaacgggattgcctttgccgaccaagacgaggtctggtttttagaaacgattggcggtcaccgctgggcagcagtccggatccccgacgacgcctttgtaatcgcaccgaaccggtttaacatcaccgactttgactttgagagtgcgaccaccttggctagccccgacctcaaggactggattgaccaacacgacttaaacccagccgatgatggctacaacctacggcaaatttgtggttcccgcacttaccgggacatgcgctataataacccgcgggcgtggtacgttcagaagctattcggggtggaaacaggggcggacccaacccaaatggacctaccctttatctgccaccccaagcaccggttggcggttgaagacatcaaacaggccatgtcatcacattaccaaggtaccccgtatgacccctatggtggtgagaaggggggccaggtccgttcaatcgccttgaaccggaacctagaactacacgtcttagaaatccgggcgggagtggcgccggaagtggcggcggtccattggctggcctttggtcccaacacctttaacgccctggttcccttctatgccaacgttaccgacaccccgagtgcctaccgggacacgagcggtcagtacgacccgaccaaggcatactggctagcccacaccctggcggcgattggcgaccaccactaccgggctttggcccctaaggttgaggcctacgagcaaacggtaacggcgctgggccgtcaattacaagcggccgccgatgcgaaggcggcgggagaagcagacctgcccgcctttttaacccaagtcaacgaccaaatggctaaagcagcggtcgaggaggggactaagctccttggtgactgcgtaaaggaggcctttttaaacgagcacctgcagttttagaattaagtagcgaacaggcgttccaacaggtataatgggggtgagacaacccaacacctacgaggaggaaaatcatgaaacgccgacgtaacaagaagcagggctggcgctggttaattgccttcgtcatcctcttcgcccttgcctcgggtatcccgggcaaggcatcttctacgaccaccactagttcaccgagtgcccaaaccctggttgccaaggtcaactccctggtggaaaacctaagctaccggtcgcgctcgtcgtcaaccagcggctcgagcacgatggtcaccccgagcaagcaaaaggccgaggcggttttaaccgccaacgttaagcaacaactggggagttcgatcacttggaatggcgatggggccttcattatcaacaacaataagaccaagctcaacgccaagatcaacaacgcgccctacgccgttgaccggctcgacagccaggggcgtgcttggcagggcgatgcctggttaaacaaaacgacgcgccaatacaagaatcgttccgaaaccgggaacggcgccactagttggaaaccggtcggctttatgcaactgaccaacttaaagaacggcccgacccacgcttatgaccgggggcacctactcggctacgccttggtcggggggctctccggtttcaacgcttcggagtccaacccgaaaaacatcgccacccaaaccgcttgggctaacgaagcccggtcaaccgattcaaccgggcaaaactactacgaaggcctagttcgcaaggccctcgaccggggtaagcaagtccgctaccgggtaaccgacatttatgacggtaacaacctagttccgtccggcgcccacattgaagccaagtcaaaggacgggagcctccagttcaacgtctttgttccgaacgttcaaaataacattacgatcaattacgccactgggaaagccaccgctactaactaaattaaagaccactttcaaccgtcaggggagaaagtggtctttttgcttagttaacgtgatcctcagctatttttgcttagtttacgttgcctacttcaaaaagcccggggcgagaaactcggcgtccgggtagtggtaaaagccctggccggcctccctgccgtagtggccagcatcgatcatttccttgagcttgtcggcgacttgcttggccatttcatcaccggtggcttggtgcttgtttaaagagatttggtaagcggtccgtaagcccaccgtgtccaagataatgaacgggccggacggggagccggtggaaatcatccagtccttatcaatttcgtgggggctagcgatgccgttgacccacaacgccattgcggcatcgagaaacggaatcagaagtgagttgagcacgtagccgggttgctctttgtaaaggtggatcggcaccattccgatggccttagcaaagtcaattacctcctccaccagttccggcttggtgtccgggttaccgacgatttcggcgacgttgtacttccaaatttcgttagcaaagtggatgtgcaagaagcggcgcgggtcaccaaagaacttcaccaattgactaggcatgaaggtcgaagagttgctggccacgatcgtcttatcagggactacggccttgagttcctcgtagaaggcttccttgacttccatggcttccggcaccgcttcgatgactaaatcggcgtcttcaacggcttctcttaggtcggtcgtgaccgcgacaatgttggccaggccggcattaaaatcggcctcggaaagcttgaggtcacggtggtaagcatcctttaaggcgtgcaaacgagttttggcgctctcaacgtggcggttccaaacggtgacccgcattcccttgagggcggattggtaggcaatttggctccctaaggtgccggccccggcgatggttacatttttgatggtcatagtggtctcctttcttaaagcaaacgattagttttgtaattagtatatcatgaaaacgttttcaagcaaacgattagttttgtaattagtatatcacgaaatcgttttcaaactgacgtggttaacggtccggcgccctgcttgagacgaaaaaatgatgaaatcacgatcccaccgggcgagcgggggagtcttgtggtaagataaaattatcatgtgactaaggcaaaccacgatgtttgtcggtccgcccttggaagcgacaccaaatcatcaatgatttatcaatcgtttagcaacgaggggagggggtggcaaggagtaattatgagaattacggcgccccccttaacgaatcataatttacaacaaagaaggtttattcgatgacaagcaccaagacgaccccccaaccacgggacctgcacaagatccacgttctccacgatgggcaaccggttgaactggggattaaagagatttttgatccggaaaagtattcccagctgatcgccatgaccggagcggtgacgcctgactttatcaacacctacttgcccgattttgtaaaggtcgaaatcggactgggcgcccgccagacggcgaccgggtacaccgccaccgaaacgatcactaaagacgccctggcaacggcgatgttaaacgccgccaacaaggaagcggccaagctttttcatgctttaaccagccaaatgcagttaaacgccgtgtccgggctgttaaagctggacatttcgccaacccaagcggtccactcccgcttttacctgctcagtaacccgactaccgagcaaacccgggtagtgttggggtcggttaacttgaccgaagattcctttgacccggcccacaaccgctttgaagaggccctcatctttgacaaccacccgctttacgaaagcttgaataaccactttaaggttgacatgctaccggtgatgcagccctacttcactaatgaactactcaacgccgccgaaaagcaactcaaggccctgaaaaaggacaaggatgccgacgctagccaggtggtgatcctctctaacgaagagaccgaccggatcgcccaggtggagttgaccaacctcttagtcaacgacgtgcaacgtcagcttgacaaggaactggtcgacccggaactgccgctgggcttgcgtaacgtaacggtcaattacgccaccgaaaaggacgaggccgagcgggcgattgaacagcgtgaaatgatcctgaagttggaaaaagaggccgtttcaccgcgggcagcccacccgaagctacgggaacgggctcagatcaacaaacgggtggtggaagccttcgaacaggcggtgacccccgaggacttagcggtcgaaaaaaagtacaccaccttcttgtacgaccggcccctggaacgcaacattgcccgtaacactactggcctctacacccccaacgacaccggtacctaccccttgccgtttgggaagctggcaaccgtttctgaaattcgggaggggttgcaccaaattgacgccgtgatccagggctatgccaagttcgtggtcgattacaccccggaatacgggcgccggttctttgaggcaatcctctacggctttgcggcgccgtttttatgggaaatccgcaccaaggctagtttgaaccccgaggacggtaatgacgtgcctaacttcttgatcctaggggcgacggccgggtcagggaagtcgactctcttacggatcattaaccagctgacctggaacaccgccaactcgatgattgacttcggcaccatttacgacaccgataccccgcagcgcaaggccaagacggtccaggccctagaattgtacatgaagacgggctccagttacccagtcctaattgatgaaattgaaccctacttcttccagcaaccgcagtacagccgccacttggtcgtcgacacgatgaaccagttggttaacagccccaagccgatcgcaccattgatcgggaccactaactacaacgggggcttttcgatggccagagaaaccgcccggcggacctactacctgcaactggataaggtgattgacgaccagcaaaaatcggaggccaccaagtacatttacaacgtccgcaagatcttaaacaacaccctcttcaaggactttgtcgtccggatggccaacctcttagaagacgaccaaaccccgtggcggacctacaataaggaaaccggcctgctcgacttcttggccatgccgcggcggatcttcaaggagtactaccaaatggtcgaccaaccgctgccggactacttcaccgacgggattttcgatgacttccgcgagagctcacgcaatcgttgggctaagctgtacttaacccaagagagcgactttgtctaccgcaaggaaaacgacagcctgctctttgatatctccaagcttaactcctttaacggctttacccaagacgccgtcgaagagtaccgcaactccttaccaatcgaaatttgcgtcgacgggatcaacggtaaaaccgggaagtttgtcgaaattaaggccggcgccttttaccactggttggggatcaacaaccctcacatggcgttgccagccggggtgaccgtccacgaaacctatgacgtcgcagagacgccacgggtgccgtcggcgattgaacacgggcaggtttcaaaaccaaagaagaagggcttttgggcccggttgtttggctagcataactcaattcaatggtctccagtcgcacgtagcgaaccgtgctgagggcctcttgttgtttgtgcacacataatctaactagccaagcggaaccggaaagggtatgatggtcaaggaagcaaagaggcggtgaccatgttcaagaaggttttgcgccgcgtggccattggcttagcggtcatcatcgtcgtactggcgggggttcagttgtacttgctgcggggaaccccgggtaaggccatcacccccaccaactcatcggtaaagtattccgccacgcccaccctcctgatcccaggctggggtggaaacacgtggacctatacgaaattaattgactactaccaggaccaaaacatcgccacgaacgtaatggtggtccgggtagcacccaccggagccgtccaggtttcgggtagcttgaagggcaagcaaaacccactgatccagttcatttacgactggaattattccaccacttaccagccccaggtgcgggagctaacccaagttttgcaggttttagccactaagtatcacgttcaaaaactaaacgtgatcgcccattcctacgggggaaccgagcttttgcatgcctacatcgggtccaaaaccctgcaacgagaaatcgccttgcaaaaggtggtttttttaggggtcccggttgacgaatcgtttgggaccaacaccaagtacaccaagtggttattcaaaaagtctcacgatcaaatgtttaaaacgatgctcaaggaggttaaggaagcacagctaccaaggggactagtcttttataactggatgggaagcgacgaggggaaatcgaccactgacggcgaagttccccaaatccaatcactaatgttaaaaaccctgattaaacacaaacacgtccactatcaccaacacatcttcaccgatacgacccacacggagcttcaccaacgggtcaagattatcaagaagattgcccacgtgatttgggggaaggagtaggtgtcttttgcaaaaggaatttcatcaagtgactgggctgttgtggaagggcgaagaggaaatggccctttaccgtcagttaaaagccctcgctgagcaacggggtcagtcggtcagtaaaaccgctaaggacttggtcaaagccgggctaagaaaagaagttggcccaaccaaaaatcaataaggaagagagaacaacatgctgtacgcatccaacgtgctggaagaagatattaaattaagtgaggaaaagaaacctagtcccactagtttacgcgactggacaatccgcccgtttacgattaacgggatctcaatggtcctcgccgttaatcacgaaaccctgatgcccgccatcattccgggagtggaatacctgcgggtcggggttgagtttgtcttagcccaagtggttaagcaaatctgcagccgcttggccattaacccggataaggcgacccgctacaccgatcaaatcttaaacggcggggtggcctaccggaacacgagcaatgacttcttgttagagcgggccttccgttactacgtggacgcctttagcaagatcaccccggaagaactagaaagctacgaggaaaacgacctgttaatggggttagcgatggaatcggtcaccctcgcggaccgggaacggtttggccgccaggaaacgccgatgatcaactttaccgatcaaatcgtcaaccaggtccggatcccgatgatcacgaacaaggggaattactttgtacggcgttgggtggacttaaacaactccccaacctacttagctaactttgacgagcaggccccggaagtccaagcggtgtacgaccaattgatcgacattaacaccgaactaatcgctgacctgatgacctgggtggaaacctacaccacaacggatgaaaagacccgggcccagatcaaggaattgctcgatcaatacctaaacgactacttaacccagcggcggccgatgtgtgtcattgatgacctaacatcgcccaccgacttcctcctccagtgggaggccttcgccccagacgacgccgatccggagccgattttattagcgttacgctacttgattatgtacatgcagaccaccgaaatgctttcgattaaggatagccacgtcctcatgcgggcggtccaagtggtgatcgccaaccggtggggggaatccaacatcgatctaaacctgggctacaaggacatgattgcccaaccggataagaccacccaggaattcattgacctaatgaagaagtttccggactcctttttcgaattcttacgtaacctctcgcctcgcgaacgcctgacgatgatcgaccagctggcgcaactgaataaagaagacgccgcgaaaaattggaagggtgacaatctttgaagagaagatggctattcggcacggctcttggcttacttgcgggaatcgggatcactggggttcgcccccggattgtacacgccccggaagtaatttcaaccaccaagcgacttcaattaacgctcaaggacgtgcttaaatccaaccacgtcaacgggattcttttaattggtagcgatgacacacccaccgtgattcaaaactcactggtgggggccaacagtcaacgggcggtctctagccaccgttacttcccgactgcgtcgctgcaaaaactgttgacgggattagccatctacaccctcgtcaaggagggcaaattatcggttgacaccaccctggcgacttactacccccaagtggcccacgcgaaggaaattacgattgggtggctgatgagccacacctcggggcttgccgacacccagacggtcgccccacgggtcctcatgagtcaaagcgaacaggtcaaatactccttggcccactataagtcgagtggtaaagaaacttggaactactccaacatcgattacgtcctcttagccgcgatcgtttccaaggtcagcggcgaaagctatgatcagttcgttcgggacaaaatcctggcgccgtgggggattaaggagattaaaccctttagtgcgctgaaggccagccaggtgtctaagagccttttgccaacggcctcttggacgagcttgcggcgggcgatgtcggcgacctttggggccgggaactacttggcgaccccggtaggttattggcaattgattagccacttgatggacgaccaggcagccagcacctggctccataagtacgccgaccaaaagacggttagctactttggcgggatttactttagcggcaatagtttccacgctaacggaggctacgctggttactcggcgattgcctcgggggacttttcgacccagcagcggatgatctttttcactaataacatcaacctagggaccgcaaaaacaattcggacgcaactgaaccgctattactacagcaaactggctcaggaactcgattaaggaggatgtagcatgttaaataaagactttaagtatcccgacaccgttgcctttgacttcgttattgacggactgaaaaagcgcggggtggacctccaccagttgagtgggatcgcctatgatttacagcacaacttcgtgcccaccattacccaggaggagtgctaccaagaactgctgaacgtgttgcacaaacgcgaactcttgaacaacgcgatggtggcgttggaactcgaccgcctggccgaagaggggcaaattaaagagcccttattgaccatcattagaaacgactccggcgtcttcggggttgatgaagccctggccctgcaaaccgccaacatctacggcacgattggggtaaccaacttcggttatctcgaccgggtcaagtacgggatcatcaagcaatacgatgaggataacgaccaggtcaacaccttcatcgatgatttgctaggggcgattgtcgccgccctgtgcggtaagttagcccacaagtacgcataggaaagtgattggggaataaccttctcggcaggtcgtatgactaagctaggacgaacggttagtgcggtacgcactgttcttcggcctgcttagacactagacctgcggttattttccacgctatctgtctaacattcgtgaatacagcaagaggccggggaaaacggaattttccccggcctcttcagttgagttagaaaatcatctgcaaccccatcaggatcacaattaaggaaataactggcttgcaaatccggtcaaaggttgcccggttaacccgggataagacccgtggggctataagcgccccggttacggagccgattatcagtaacagggcgtaaaagtagctaacgcccccgccagtcatgtgcatcacggcaccgattaaactcgtccaaacgaggatgaagctagacgtggccacggtgcccaacatatcttcgcccatcgctagcaggccggccatgatcacgccgccaccggaaagcccaccgatgccgatcattaaaccggacaagatggcgtaataggctgccttgacccggtcgacgtggatatcttccgtttggcgcaccttgcgaaagtacatttgaacccctaacaccaccaagacgagtccaatcagcggggcgtaaatcttttcgggaatgtagcgggccaacaaggaagctacgatcacggttggtaaggcgaagtacagaaactggcgggctagtttgacgttgacgttgccgtgacggtaaaaggacagggcaccaaagcacagggcggggatggcggttagaagcgaggtatccaccgcgtgggcggcacttaacccgcacagccccgttaaaaccccaaggtacaaagcggccccgccacccccggttgagataacgaaaaagccaatcagaaaaccacacaccactaccaacaaatttaacgtcaaatctgccgcctcctttaactaaaaacacgcttattatacactatcacccccaccttggcgcactagggtgggggtgagtttagtttaattgccgcttggcaacgtcggtttttaatagttggtagaaggccgcaaagaggggcacggtgaacatcatccctaggatcccggaaaccccgccaccgaccatgacggccacgaagacccacacgctgggcaggccaatcgacttgccgacgatcaacgggtaagtaacccggttatcgaattcctggagggctagaatcatcaccaagaagatcagggccttgaccggggaaacggcgaagatcacgatgatccccacgctggcccccatcaaagccccgatgatcggtacgagggcggtgacggccatcaccgcgccgaccattggtgcgtaagggagttggagaattagcatcaagacggtgcacgaacacccgagcaccacggcgtctttaacttgccccacgatatagctagaaaaggactggtcaaacaccgtcagtacccgtaaaatccgggccacttgccccggcaagtaggtggtcaataagagcttgaactggcgggcgagacggtctttaaagagcaagaggtagatcgaaaagaaaatcgctacgacggtcgtagtcagggcggaggccaccttgctagcggtggacatgaccgtgctaaaggtgccactggccccgtttaagaggtaactttgcaccttagtccaattaatcttagagaggtcaatttgttgccagaggctctttaaaaagctctcgttttctagccagttgatgaactgggggatgaccttgctttgcccggagaagagcaacttaacacaagctactaactggggggccaccacgctagaaaccaccccaatcaccaccacgattgataagtaggcgaggcaaagggcggtgacccgggcaaacctttgggcccgctgtcccttaaagacccggtggtataaaccttcgtagcgtaccatcaacaggttaacgatgtaggcaatcacgcaaccaatcaggaggggcatggctgccgccaataatgttttcaacaggcccgcaacgtttggccaataggtaatcgccaggtataaggcgaaaatagccaccactaagggggcataagggagtttgaataatttacgcatacaatcctcctaacggtagacgagggtggcagcgcccatcccgccgccaatgcacagggtccccagcccccgcttggcgttttggcgcttcatttggtagagtagggtcaccaaaatgcgggccccggagtcgcccaggggatgaccaagggcaattgccccaccgttgacgttcaccttgctctcctcgaagcccaattcgcgctggcaaacgatcgcttgggcggcaaaggcttcgttaatttcgattaggtcaagctggtcgggcgtcatgtcaacctgggcgagcagcttcttggtggccgccaaggggccgatccccatcagttccggcttgaccccggccaaggtaccggcctgccagtagccgagaatttccttgccttccgccagagcccggcgttcgctcattaggattaaagcagcggcgccgtcatttaatccggaagaattgccggccgtcacgtcgccaccttctttaaagaccggctttaaggccgctaatttttccatcgtcgtgtcgcgaatcgcctcgtcttctgtaacttcaagttggtggcgcttgcccttgacggtcaccggcacgatttcgtctttaaaacgccccgcgtcttgcgccgtccgtgcccgcacttggctttgcagggcgaagtggtcgaggtcttctctagtcacctggtatttttcgaccaggttttcggccgtgcaacccattgggtagtggaagaaggcgtcttccaacccgtccttatacagggcgtcgaccagttcggcattaccgtacttgtaaccaaagcggcccttgggcatcaaatacggggccgtcgacatgctttcggtgccccccgccaccatcacttcggcgtcccccatggcaatcagcttggccgctaggttaacggcgtgcattccggagccacacatcacgttaacggtggtggccggaacggtaaccggcaacccggcggcaatgctggcctggcgggcgacgttttgcccctggccggcctggatggcgcagcccaggtagacctcattcacttcttcgggagcaaccgcagcccgctctaaggcggcctggatggcaattgttcccaactgggcagcggtcagtgtggccagggcgccaccgagctttccaatcggactccgtgcagctccaacgaaaacaactttttccatacttatcaaccctcatttgtttaatattaacagtctcatctattttaacgaaaaaagcggggagtgaccactttgatcactccgccgccatcaattagttctccaggtagttgagaacgtcggctaagatttcctcggcttgggcctggccctgttcgtagagctggcgaatttttttaacgttgccctctagacgcttgaccttaattggttctgtcggggcgatcacaaaggcttgccggtctttttcaagttgatcgagcgtttcgacctgctggttgtagacggttggccggttaatcccggcatccacgaaggccgggtagtccttaaaggagtgctggtacatctcactaagcacccggctggtcggcttcttgcggtagtcacgcggccgggtccggaccaccacgatcttgtcaaagtcctgctcttgggcgatgtcgaagggggttgaatcggcaacgcccccatctaaacagggaccggcggtggttacctggggctcggaaacgaagggcatcgaagaagaggccttcaggtcggtgatgaactcttcgcccgtcgcgtttgtgaaggtgacggccttcccggtttctagagcggtggcgacgatggtgaaatcggacgccgaacgctggtaggcccgttcgtcgaagttgtgccagtcccagccgtggtcttcaaacaaaaagtccaagttcaaaatttcctcgcgctttaaaaggcgcaggggggagatgtaattgcggtcgtgacggtagtgggtgttaacgtcagccattcgtccgtactgcttagaaacgaagttcgccccgcacagggccccggcggagaccccaattaccgatttgaattcaacgtggtgttttaaaaaggtatcggtaacaccggtggagtattgaccgcgcatcgccccaccttctaaaactaaggctgcgttatataacatgaaattccctcctgtcgactagatacagaaattatagcaccaccggattgccaacataagtgacgaaaaccctaattttgcctaaaagcgccttcatcaatggattttcatttggaggttggcggactgaaaagcggcgatgaggtctcgcagggcgtcggtgagcggacggtcctttttggcgccaataaagtagcggatttggatcagcgaggggtcgagtgggtagaggttgattggcgtttccttaatccgtttgaggatgctggcggccgaaatcgtcaagcccaccccctgaatggcgaggttggcgaccgtgatgacgctgtttgagaccatcaccaccttgggaaccagcttccggttttgaaagaggctgttaacctggtggcgaatttccgattcggcggagctcaagacgaagggttcttgcaagaggtcgtctaggttatacgttgaagggtcgaggatgaagcgaccgggttggtaaaacttggaggtggcggggatgatgacgtagtagttctcgccgccgttaatgtaggggtgaatcccgtaatttaaggtttcgggggtttggcctatgtaaaggtcggcctggtcatttaaaatccgctcctcgctttggtgggggaagccttcgaccacttggatccggacgctggggtggtcctttaagaagcgggggaggattgccggcaacaagaaggttcccaggctctctaaaacggccactcggatgatttcggtgctgtcgttggtgtagcgggctaattgaagtgcaaggcgttgatgttcggctgacaggttctcgaggtactggtagtatatttggccggcttccgttaaagagaagggtaagcggtggcggttgataattggggcgcccaattccttttcgatccgtttgattagctgggtcaaatagggctgggagatgtaaagctcgctggccgccttagtgaagttgctgtgcttaagcaagacctctaagtagttgagcatcaaatccgggtcacgcacgttaaccatcctttcgataacattttagttatgatccaataataacacaggtcgttcccatttccgttcggaagcgctacaatttactcgaacatgagattgatttcacaagggagcgatgaacaatgaaagcaggaacgtacaaagtaaaagctaaggggcacggctcatccttcatgccaatggaggtcacgctaagcgacgatgcgattcaacggattcgagttgacgccagtggggaaacaagcgggatcgccgacgaagtttttaaacggcttccggctaagattgtgaagggacaaacgctaaacgtggacaccgttgccggggcgacaatctcctcacgtggggtcgttgacggggtggccgaagcgattaccctggccggtggcgatgccgctgagtggaagcaacgggccaagccagaaatagcgactcaggccgctcaagttgaggaatatcaaaccgacgtggtggtagttggggccggtggggctggcttggcggccgctacccggagcctccagcacgataagcaagttgttattttagaaaagttcccgcaactagggggcaacaccacccgggccgggggaccaatgaacgccgctgatccggactggcaaagggactttgccgccttgaccggggaaaaagagaccctgaaagagttggctaacacgccattagaacagatcgaccccgaataccgtgccgactttgaacggttacgggagcaaattaaggaatacattgcttccggagcccagtacctctttgattccaacctccttcacgaaatccagacttacttaggggggaagcgtgaagacctcgccggtcatgaaattcacggtcggtaccagctggtcaagaccttggtcgataacgctctggactcggtcaaatggctagctgaccttggggttaaattcgatcaaaccgacgtaacaatgccggttggggccctgtggcggcgtggccacaagccggttgagccaatggggtacgccttcattcacgtcctgggcgactgggttacggaacacggtgccaccatcctgaccgaaacccgtgccgaacacctcctgatggaaaacggccgggtagtgggggttgtggcccacaagaccgacgggactaaggtgaccgtccgtgctaaatccaccttcttgaccgccgggggctttggcgccaacacgccaatggtccaaaagtacaacacctactgggagcacattgacgacgacatcgccaccactaattcaccggccatcaccggtgacgggattagtttaggccaggaggcaggcgccgagttgaccgggatgggctttatccagttaatgccagtctccgacccggtgaccggggaactgtttaccggcctgcagacgccaccggaaaacttcatcatggtcaaccaagagggtaagcggttcgtcaacgagtttgcggaacgcgacaccctggccgccgccgcgattgcccagggaggcctcttctacttgatcgccgatgataagatcaaagagacggcctacaacacgacccaggaatcaattgacgcccaagtcgaagccggcaccctctttaaggcggatgcgttagcggaactagccgggaaggtggggatggacccggccaccctggaagacacgattaacaagtacaattcttacgtcgacgcgggccacgatccggagtttggcaagagtgccttccaccttaagtgcgaagtgacgccattttacgccaccccgcgcaagccggccatccaccacacgatggggggcttggcgattgatgaacacggtcacgtgctagacaaggcggagcgagtaatcgccggtttatactccgccggggaaaacgccgggggcctccacgctgggaaccggctcggtggtaactcgttggctgatatctttacctttggccgcttggccgccgataccgccgcacaagaaaacggctagggggacaggacaaatctaaacatttgtgcagtctctaaagcttcctgtcgtaaaaaaccgaaataaaaagatcctgggaaagtcgttattcccgggatcttttttctactgattactcttcaaatcaaacttaaccgtcttatcgttccaaactgaggtctggtattggagctggagcttagagacgctcgtgcttgcctggccgaccatgttaccggtcaccgaggcccccttgtctaaggaaccggcgtttaaggtgttgtcgacgtcggtgtagatttcatcgaggtcggtgttattcccgtcggcgttgagcttaaagtcataagggttgtagtcttgcgattcgtcggtatcgttggtgatcgtcacgttgacaatcacgtattgcttaccggaatcgggctgttcgtactcgttaccggaactgtacgaaacgctattgaccttaatcttataacccttatacgaggcggtttggccgaccttgtacaccttatcgagtggggtggccgaactgctcgagctcgaggcggacttatctgagctatccgatgaaccggagccacccatccccgcggcgacaatcaccactaacaccacgaccactaaccagaaccagacccgtttataaaagggcttcttttctacgtacacgtgaccgttatcatccttaatttttcttgccatgaggcttcctcccgaatagcagcttttaacgtcgatcagtaattggacgtaggggtgcacccatttaaccaacccccattggttaacggaccccgcattcttcgatctagattttctatctatattataaagggtttgataaaccgcttccacccctattttatttggcgaggggggttgctcatttcttttggcgactgctatatttagggttaacactttagaagaagagaggggattgaatgacaaaatcaaacaaggggatcctcctggccatttgcggagcgtccctgtggggggcctcgggagctggcgcccagctaatcttttcacacacgtcaatgaccgcatcctggttagtggccgtccgcctgatctttgccggcttaatcatgacggtaatcggtttggtgcgcaacccggggcaaaccaaggggctcttaactaataggggcgacctagggattttaattgcatttacctttttggggatgctgaactcccagtttacctacatgaaggcggtacaaacgagcaacgccccgaccgccacggtgattcagtacctacaaccggtgttaatcattgtctggtttacccttcgtaaccgggcctggcccaggcggctagacatactttcgattacaattgctctggtggggaccttctttttggtcaccggcggacacttgaactcgctatccctgacgccgatcgccctgttttgggggttaatgtgtgcgctggcggccgccatctacaccgtcttaccccagggcctgttaagtcgctacgacacgctaaccgtctgcggcctaggaatgctgatcggggggattttcatgagcccagttttggtccttacgcccttacccaatatgacggccttcgattggggaacccttgtctacatcgttatattcggaacgatcctggcctacaccctctttttgagcagcattaattacatttcaccagccgtcaccgggatgttgtcggcctttgaaccactggtcgccacaaccttagcggtggctttcttgggaaccaagttgacggcggcgagcgtcttgggttcattattgatcatcctgtgcaccctgattcagtcgctgccactcaaacgaatcttggatcttttgcaccttgccaagcactaaccataacctttgataatgaaagttgcccttacattagtccatttaagtagtgatcgataaggagcgatgctcaatgtacaaccaaattaccattacgccaaccgaactgatcgtttccccggccggcctcgaccgcctctgggcgctgaagggagccattcgggtgccttggaggcacgtgaccggtatctttcgtgatcagggggcctttgaggagcgcaaaggtttgcgcttgcccggaaccgcaattcctggtttatactacgccggtagctttttttatgacggtcaacgccgcttctataacgttcgccgtaatagtccaatcgttgttataacgctgataaacgaaggctacgaccggctgattttgagtgttgaaaaccccgccaccgttatcgaacgagtgacaggtcacttgttaaacgaggcgtaaaataaaatcaaaattttcgttactcaaccgactttttacccggcaacggcgcgaaaagccggtttttgtgtgcttataaataaacgtatttttcttatttgaaaatctattcgatctatcttgtctatcgggtgtaaaataaatatagtcaaaggggtcgggatgaaggttattcaagtctcctcatatactactgataattcaccctttgaccgtatttttatccactttgatttagtggattgggaatcttgatcttcactccgataattatcatgtacgattacatatagactggcggtgaatttacatgtcgataagcgaagcccaaaagcgtgccaacgtgcgctaccaaaagaagaacccagatgttgttcgtcggattcaatacaagagtcgggggaagaactttatccttaaatcggcaaatgaacaggaccttcgtcaatttgaagaatggatccaaatccgccagcaacagctgaccaactaaccagggacgtccgaaggggcgttcttttttttgtgcacacaaaagcaattttattaaattaactgacgcaaactagctcttcattccaattatcgccccctttatcgaccggttgactttgttgttttgacagcgcatactaaaaaacgaactatttcccgatgagagaaattatttgcgataagggtgaagtcagaatgaagaacagtacactgaaaattaagctactgccggcttggcaacagactcaaagacaattagttcgccacgacatgataagtgatcgatcgataaaatcattgctgggtgatggcccgttaaccactttgggggaggacctggtggagcgactattcatggtggcgcccaaagaggagttactggaacggtcactgaagctgaccctgcttgatgatgatcggcccggtacccccgcctttacacccccgtttcacttccagcataacgctaaaaccctctacttacggtggctttgtcaccgggaccacaactgcctgcgggcggtggcggtgcgggggacgctcaacctcttgcaaaagtacgaggaccagtttgggcgctccctgcttcaattcacgatcgctaacaccaaggaagtggtccaccaaatcgttagttccggcttgaccccggtgatgatccggcgccaccaggataatttgattgacttttgtgacttttgccgcctccataccaactgccgggtgaaaaaccactggcaactctttgaacgggccctcaagaaaaccgcccagtccaacgacattttcttcacctcctatgaggacctggtttcgcccaaactgtcgacggtttgcctgactgaaggtaagcacggctcgatcttgccccagattatcgccctgctaatttttaagggggcggaattgactacggcttgcgctacattcaaaaccgtgacttgggcgaccaccgcctgcggattacgacccgccacggcgtccggagcttgcgcctgtccgaccgggaagaggaactgctaaagcaactcgtgggggaaaacgaggataaggtcggctgctatttaattcacggctgccggcgggtacaaaaccaaacgatcaagcggtgggcgattaaccataagctgcgctagctagcagctgatttctacggcgatcaggagctaatgagctaccggacgattcgccgtagcgggataccgtagcgggatgatgtattggctgaccgagcgggcccaggaacgcttcggggctgtcagggggctttcggttgaccagcgcagcgccctgattgatgagttgatggcaacccgggatttcaccgtcgccgccaccaacggccgggtaaccatccaacgggtctgggatcagtacttggcctcaaccaaacacgggattacgggggaatagccacgggattgaccacgttttcaaagtgagtgcggtctaacctcctcgacgggccgtagggctaaggatagggcacaggttaacgccctcggcggtgttctgtggccagacttagccactaggcccgtggttgggagcacgttatctgactaacattcgtgaacacaacaagaggctgggagaaaactgtgttttctctcagcctctttagttatttatggtcagattttttgttctacgtcggttacgtgcacgaccaggactttccgcagccaagggaagttagccttcatctggtcgaagtattcgccgctggctaagaactccccggttgcgtggacgtggtagccccgccccatcccttcggttcctgcaaacttcttggagccaaaggcgatcgttaacggactggactttttctggacgtcggcttcaattgaccgcatcccggcggccggaattaagaaggtttggtcatcaataacctgaacgtagtcgctccaggtgttaacgacgtgcgccggattaccttcgacggagacgatggtgactggctgcggatctggcatgatttctaataggcccttggtaagggtggtacttttttcaagcattaaaatgcccccattctttttgatgtacttactttatcgtataatggtgtcagatcttgtcaccattgcaaaaaggggaaatgaacttgcaaaaatccgcccgcctcaaccaagaattgatttacctcagcgataagcactcctttcacttaagcgacctaatgaccaccttcaaaatctctaagcggactgccctccgcgacattgaaagcctagaacagttaggtctcgccctttattcaacgcctggtccggctggcggctaccacctaattcaagaggggttgttaacgaaggtctactttaaccctgatgaaatccacgccatcttcttcgccctcaaagcgatgtcaatgatgagcgaaacgccctttaacgaaccttttaaacaaattagggccaagctcctcatgaatttagcccctaatcgccaagcgggggttcggcggctagaagatgcggtcgcctactacaccgtccctgcggtcaaacacaacccgtacttgcggaatctattgacgattatctcacacaatcacttagccagcgtcacctttaacggtcaggctctgaccatccagccctatcagctcctttaccgggacggatattggttggtggctagctgggacccgaccagtcaaacttgctggaactaccggtgcgactgcctgactagttgccaagagctagcctcgcccctagcactaaccaaacaagagctccaagcaaaaattaagctctttaatcacggcgagggtggggtcaagttcaaggcgttgttaacagagcatggtcgggaccacttcttgcggagtaattaccccagcatgcgactggaagaaaacgccggccgctactacttgactggctattataacgagcggaccttcgattacgtcgtcgactacctcttaacctttagcaaccacgccaagcttatagagccccaaccgctaatcgacggttatttaaaaaaattgcgcaccctgctgaatcagtatgccgattaagtgggtggaaaataactttctcggcaggtcgtctgacttagctagggtgagcggttggtagggtacgtaccgttcttcagacggcttagacactagcaggcttgcggttatttgccacgttttctgtctaacattcgggaatacaacaagagcctgagagaaaagcggctcttctcctaggctcttgtgcttagtttttaaagctgtggacgggggcggggagttggccaccacggtgaatcatggcggcagacgaggccttattgacgcccataatcggggcgtggcccagtaaaccaccgaactcgaccgtctcgccaacctgcttgccggcgaccgggatgacccgcacggcggtcgtcttgttgttaatcatcccgatggcggcctcatcggcaatcatggcgctgatcgtttcggctggggtgtcccccgggatggcgatcatgtccaggcccaccgagcagaccgccgtcattgcttcgagcttatcgaggcttaaggtgtgggcgttgaccgcgtcaatcatcccggcgtcctctgagaccggaatgaaggctcccgacaaaccgccgacgtggctgcaggccatgatcccgccctttttaacggcgtcgttgagcatggctaaggcagcggtggtcccgtgggtgccgacttgttccaagccaatttcctctaggatctgggccaccgagtcgccaatcgccggcgttggggccagcgagaggtccacgatgccgaagggaacccccaggcgttgggccgcaatcgtgccgactagctgtcccatccgggtgaccttaaaggcggtttgcttgatcgtttcggcgaccacgtccatgggttgccccttgaccttttccaaggccgccttaacgaccccgggaccggaaaccccggcgttgatgacgacgtctggttcgctgaccccgtggaagcccccggccataaaggggttatcctcgacggcgttacaaaagaccaccagtttggcgttggccatcaggtccaactcactggcccttttgatcaccgttcccatgtccttgacggcgtccatgttaattccgctacgggtggaaccaacgttgaccgaggcgcagaccaactcggtttcggccagggcttggggaagggagttaattaaaacgcgatcgccgctctggtagcccttttgggtgagggccgagaaaccgccgataaagtcgatcccctcggcgtgcgcggcccggtcgagggtcttagcgtacttaacgtaatcggcgtcaccactggcggcggcaattaaagcgattggggtaacggtgacccgcttgttaacgattggcaggccaaattcggcttcgatctggcgcccgactttaaccaagtcctgggccttagtcgtgatcttgtcgtagatcttttggcaggcccggtcgctgtcgctatcgatacaatcgagcagggaaatccccatcgtgattgttcggacgtcgaggttttcgtcggcgatcatccgaatcgtttcttggatcttttcgatttccatggcgccctcctaaagttggtgcatggcttgatagagccgttcgttgcggatgttaatctccacgccaagctgggtgcccaggtcctttaagtcggcggctagcttagtgaagtcctggtcagccgggacttcaaccatcatcatcatggtaaagtagccgctcatgatcgtttgcgaaacgtcgaggatattaatctgggcggtggaaaggtagtggctgaccccggcgatgatgccgacttggtcttgaccaacggtagtaacaattgctttcatgaagatcacctcaatggttataatttgctctaatcatacgggcttccgaacggaaatgcaattgttcttccagacgttcgggtcacttttttctaaatcccttattgacatacaaaaagtaaccggttatagttaaagcactttgaaaggagggaacaccaatgactaacgtatttactaagcaagccgtatgttgttgtggagcgcgtcaattacgcggctccactctttggcgttccctcaaacggggataagcttaatccggagtaagtgtaattggcgctgattcagcttgaatcggcgccttttttgtatcctcagttagaaaaggagtaaccaagatgctagttcacaatgtttaccaattaatcggccacaccccgctcttggagttgccgcttgacgtccccaacggcagtcacgtctttgccaagttagaaatgtataacccggggggctcgatcaaagaccgcctggggatggccctgattgaagacgggatttcccgcggggcgatcacgaacacgaccacgatcattgaaccgaccgccggtaacaccgggatcggggtcgccctggctgccgctaagcaccgcctcaagacaattctggtggttccggagcactttagctttgaaaagcagacactgatgaaggcgctcggcgcggaggtaattaacacgccggacgagggcggaatgaccggggccaccgcaaaggccttggagctggccgccagcattgccgattcctacgtgcctaaccagttcgctaacttcgataacccacgggcctacgaacggacgctgggcccggaaattatcagtgacttaaacgggcaaccaatcgacgcctttgtggccggggccggcaccgggggcacctttgccggaaccgctaaggcgctcttaaacgtctacccgaacgcttacacggttgcggttcagcccaagggatccattctcgatcaccaacccaagggcgaccaccgtaccgaggggattggggttgaacaggtgccacccttctttagcggtttaaagatcgacgaggtccaaacgattaccgatgacgatgcctttggctgggttaaacgggcggctagggagctggggcttttgatcggctcttcctctggttcggccctggccgccagtttgaaggtcgccgaaaaactacccgccggcgccaatatcgtcaccattttccccgactctagcgaacgttacttaagcgaaaacatttacgaataaaggagaaacattatgaagtttaatacccaattaattcacagcggcattagcgaagacccaaccaccggggcggtttcgaccccaatttaccgctcctcaaccttccgtcaacacgtcctcggcggtggcaccaagtgggaatatgcccggaccggcaacccgacccgtgcctccttggaactcttaatggcccaactagaagaaggggtcgctggcttcgcctttgcctcgggatcggctgccatccacgccgtcttttccctctactcctccggcgatcacttcatcgttggtaaggacgtctacggggggaccttccgtttgatcaacaaggtcctgaagcgtttcggcctcgaatttacggttgtcgacacccaggacctagcggcggtcgaagcggccgtgcaggacaacacggtggccatttactttgaaacacccaccaacccgctcttggaggtttcagatatcgaagcgattgctaagatcgccaagaagcatggcttaaagacggtcattgataacacctttgccacgccgtataaccaacgcccgctgaccctgggcgccgacattgtagttcactccgccaccaagtacctgggcggtcactccgacgtggtgggggggattgccgttacgaacgacgaggaaattgccgaacagttggccttcatccaaaactcaattggcgctgtccttgggcccgatgactcctggcttctgatgcgggggattaagaccctcggcgcccgaatgcggatccaccatgaaaacaccgcagccgtcattgaactgttggaaaaggacccgcgggttgctcgggtactgtacccggggctgccagatttcccgggacatgatatcgcggctaagcaaatggaccacttcggcgccatggtgtcctttgaactgcaagcggggctctcggcaaagaagtttgtcgaaagcctgcaggtgatcacgctggccgaaagcctcggtgggatcgagagcctgattgaagtgccggcggtgatgacccacggttccattccgcgtgaggtccgcctgcaaaacgggattaaggacgaattaatccgcttgtcggttgggatcgaagacgaagaagacctcgtggcagacttacagcaagccctggaccaactgtcataataaaaaaccgccagcggtgcaagagcaccaccggcggtttttatacggaaaaggtcaggaaaaccctttttccttgtcccttattttaatttgcgtatgttagacagaaaacgtggtcaataaccacaggcctagtatctaagccggccgaagaacgatgcgttccgcccctagcttagtcatacgacctgccgagcaagttatttgccactcccttttaattagtcgatatcgttgcaaattacgaccggcttgattaagtccgccggcttgtggtgcatcagttcgatggcgtccggaatcttctcgaagccttcgaagcgatgggtgatcattagtgatggatcgatccggccgttcaccacgagggcggccagcttttccatccgcaggcggccaccaggcatcaggccaccgtggatggttttgtgacccatcccaacaccccagtcaccggcgttgaagaccacgtcgtcgtgaccgtttaagtagttaacgttcccgattgagccacccggcttgagcatccggacggcttcttcaaaggtgtccttggcgttcccaccggcgatcagggccttgtcgaccccttggccaccagtggcttccaggatttggtcggaaatccggccgttgtggtagtcaatgatgtcggttgcgccgtactttttagccacttcgaccgtcttttcccgtgaaccaaccgcaaagacgcggccagccccgtggagcaccgccccgcgcagggccatcaagccaaccgggccgatcccaatcacggcgacggcatccccaaaggtcacacccgccatttcggaagcgtggaggccagttgggatcatgtcggaaagcatgcaggcctcggtcgggtcaatttcatccggtaggtgagccaggttcccgtcggcgtcgttaacgtggaaacgagtggcgaagaccccgtccttgatattagagaacttccagccgcccagcatcccgtcggaatcagtggcgtagccagcttgggagtaaacgtcagaccagtttggcgtgatcgccggaacgagtacccggtcacccggtttaaagtccttgacgtcttcaccgacttccacaaccaccccgcaggcttcgtggccgagaatcatattctcccgtggccctaaggcatcttcaaacacggtgtggatgtcagaagtacacggggcaacggctaggggacgtaccagggcgtcacggctgcccaccttgggatcttctttttcaataaagcccgtcttgttggggcccagcattgcaaaacctttcattcataactaccacctttcttgattagttgccgtcattctaacataaatcatgttataaccaagtcttcatatgtgagtttaattaatttcaaagaaagcgttctcattccctgaaagggttaaaataacagggattatgatagttaagaaattgattggaaataaataaaatgactgtgataatcccgtacgaggtcaccacagtcattaatcattctataattagcggattatttagcttttaaattcccaacgaagagggacgccaccccggccaccaaggcggagatgaccaggccgaagaaggccgtgtcgtatgaaccgctcagctgaacgatccagccgattaagaggggaccgaagaagcccccgagttggccaccaaagttaatcgtcccgatctgggagccataagtcttttgcgggaagagttgggccgcgtaggagaagatcccggtgaaggctagcgacttgacgaagtaggtggccatttggaagatcactaaccaaaccaggctggtggacttgtagagtccaaacatggtcaggaccgttaaaaaggaggccaggataatcatcaggcgttcgtgatttttaaagatgtgcaccattacgtaaccggaaatcaaggccgcaatccccccggcaatcgtcggtaggggaactaaccaagccaagttggctaagttgatgtggcgggcgtttaagaagtaaaccggcatccaggtttccatccccttggtgataatgtttaaggccagcccgatcaccacgaaggcccagacccgcgggtcgatttccttccagtttatcttttgccgttcttgtttcgttaccgtttgtccaccgccgtgaccgcggaagaagaggtagctgaccatcaagagtaggccaaagccccccaaccagaagaaggccgagcgccaaccggtggcggcgatgattggcacaatgatgaaaggggccagggccgcgccggcgtagttagaggaaattaaggcggcggtcagttgggcacgcttgttgaccgggaagtcctgggcgacttgcttcatggcggccggtgggtaagggccctcggcgatcccaaacaggaaccgaattaccaagagggcggctaaggaccaggccagcccggtaaatatcgtcatcaccgaccaaaaggcgagggtggcgatgatcaccttacgggaagagaagcggtcggtcagccagccccccgggatttgcatgatcgtgtagcccaagaagaagacggaactagtcgcccccagtgcggccgggctaacggagaaatccttgccgatcgcggccaacgataagttaagcacggtccggtcggcgaataagagcatgtaaccaaggtataaaatcacaaaggaaccgagcgacagcgcccggcggttgggttttgcatccatcatttatttgtatctttcttttctcaattgattattctgttgtggcatgactaagcgttagcgaccaggtcttgtaagcgaaacttttggaccttgccgctggcgtttttcggtagggcgtctgtttgcaagtagaccttgggtaccttatagtgggccaggtgttcacgcccgaaggcctccaactgctgaaagtcgacgggttgtttgctgacgaccacggccacgggaacggcgccccactgttgatcattacggccgaccacggcaatttcttggatacctgggtactggcgcaagacgttttccacctcggcggggaaaatgttttcgcccccggagatgatcatttcatctaaccgtccgtcaacgtacaagaaaccgtcttcatcaaagtggccgacgtcgccggttcggtaccagtcgccatcgtgcttagccgcaaacttggccggttggtttaagtaacccggggttaaggccggggtctggatctcgatttcgtgatgctcacccaccaaacgcagctgggtggtaaacaggggcttaccgaccgaaccaaggtggtaaggcgcctcttcagccgatagggcaacgaactgcgagcaagtttcggtcatcccgtaacactggacaaccggcagcccactttcttcgcaggcgttaagggtcgcccggtcaatcgtcccaccgccgagtagcaccaggcgaaaggccgatgagtaacagtggtcatttgcttggacgtcttcgagcatcttctttagcatgtagggaacggccgaaatgatcgtaaccggttcgtcctccaggatttggttgaccacttgcgcatcgaaatggttgactaggcgaacgcccatcccgtaaatcaggccccgcattagaattgaaaagcccgaaatgtggaagatgggggcgacgcacaaccagaggtcgtttggcaacaccccgaggttcaaagatgacgaaatggcggaggccaagtggttgccgtaggtttgcaagacgccctttggctgaccggtggttcccgaggtgtacatgatcgaggccacagcgtttaggtcaaccgtcggcgtcaacactgccgccggggcagtgccggctgtcaattccgaacagaggacccggtgcccaccgtaatagcggtcggctagttggtcatcgactaagactaggtcgagccccgcgtcgccaatttggcggctcagttcttcaggggcgaggcgccaatttagccaaacgatggtcttgtcggcggctaagacccctagggcggctaagtaaccagccaggttattgtgggtcatcaccccaacccggggctggtccgtctgcgcttgaatctggccagcacggtgggcgaccaggggaaccagctgggcaaaggtgtaggcggtggtaccgtcgttaaccgccacccggttagggtttagcgaagcctgtttgaggagccaatttggaatctccatgacggcctcctacgggaacttcgggaacttatcgaagtcggggtcgcgcttttggttaaaggcgtcgcgcccttcctttccttcgtcagtcgtgtagtaaagcatcgtggcgtcaccggcaaattgttgaagccccgctaaaccatctgtatcggcgttcatggccgccttaatgaagcgaagggcggtcggtgacttctttaagatttcatgacaccagtctaaagtaactgattcgacctcagctaggggcgccaccttgttaatccagttcatttggtaagcttcgtcagccgtgtagaagtggtttaagaaccaaacttccttggcccgcttgtggccgatcacccgggctaggtaacccgagccataaccggcgtcaaaggaacccaccttcggccccgtttgcccaaacatggcgttgtcggcggcgatcgtcaggtcacaaaccagttgtaagacgttcccgcccccgactgaccagcccttgaccatggcaattaccggcttggggatgatccgaatcaagtgttggagatccaaaacgttgagccgggcgatgtggtcggggccaacgtaacccccgttaccccgcacggattggtcaccaccggaagaaaaggccttatcgccggctccggtaagaataatcactccaattgtgctatcatcacgacagatgttaaacgcgtcgatcatttcggcgaccgttaccggggtgaaggcattgtgcttttccggccggttcatcgtaatcttggcgatcttatcgtcgcgttcaaaaataatttcggaatactccttaacgggggtccagttagcactcgtcataacaaactcctttacaaaatccagaggtacaaaaatgaatttacttgaaaacttaggcattcaccaggacttggtgaccaaagaccgcgttgaactctccatgccggtccaagcaaagcacttgcaaccgtacgggatcgttcacggcggaattaacaccgtactggcggaaaccgcagcctccctaggggctaacgccaacgtagcgccggggcgaattgcggtcggggtcaatgttaccacacaacatatccgtgcgatacgggaaggggagatttttgtggttgcaacccctgatcacgttggtcacacacttcagacctggcaagcccggctgctggttaacgaccgattaacggctaccgcaaccatcaccctgatgaacgtcccagcaccaaccaacaatcataaacattaattcacaaattggctactattatgcttagaaagttgccgggtgaccattgggggattacctaaatcacattttttaattttatattatgtaaatcaatcgagaagtcgtcggctaactgttacgaaaggggcgccactacgcagtcgatttaagttggccccgattttgtattagtgttgcaaccagtacgcaaaagcacacataatttatcgaggggaggaccagatatgaggaaatggtgggtggaattgaaactggtcgtcttttgcatcgccgctcttttcgggtaattactctaacggcgctaattagacttacttcggtaaatttacattatgtaaagatatcgtttgatgattaaagaagcctcaaaggtcctccgaggatgacaatacagatgttcaagacttaattacgtacgctagttgtgtattcaatcacctgaacggtgtgccagaaaaggacttggtcgaaagcccaaaagaggacacccaataacaattggggaactcagacgctctgactttgagctggacaaccagatcgccgatattgcttacctcaaaaaggagcttttaaacatcggaatcatgcctagccaggtcgatcaagaagatatggttgatctccttgaagtctttgccaccctcgaacagatgatgcattcatcttaaatcgccaaaaaaactacaaaatagtataactaaggtgacaaaaaggaggtgctggagattacttgttaaaaaagccgactccgttacggggccggctttttgttttggtaaaacattaggagcgtccttcttcggtgcttgttcctgtgattcgacatcgatattttccgcaacgttctttggttgctcgttaacatcttgtggcatgttgaaacctcctactcgcatttaacggcttgggagcctgtctcgggttttatttaacgtccacaactgcacggaaacggacataaaaaaacggctaccatctggtaaccgtttatagccattctttaaacgacttaaagattctaaaagctttctgcatcattgagttctcggccaggtattccaagccttcgatagtgattcttgcgtcctggaacgaatacaagactccctccttcgtgtgggtgaaggtaactccttcaatgtagttgtgatcgctcaacgtagttgtgatcgctcaacgtagttgtgatcgctcaacgtagttgtgatcgctcaacattcgcaatgtctcaacgtactgggctttggaaatcagcagcgttcgctcattaatcacacctggatcaggttgttcaccatgttcataacagtacttgaggtaacttagaattttataggctaccgtgaagaaatcgttacttcccattgtttgacctctcttggcgacgtttctcgatctccctaaaccttttgtgggcggcttttttataagcttcccgtctttttagttcttcaggagttaattttgactttgggacatccttcaaccactctcgtaactgttcagtagttggtcgatccaaagctctcaatcgtcgcatctcttcatcattcaacttcttccacatcgattatgtttttaccattctcatcttggtagtattttacaactttgaatcgagtcccacgagggaaaaggatttcaccttcatcacttcgaatactagaaacatatcgttcactatggctctttccaatgatgatcctaaaagtatcatctttatcgaataccttttcccgattccccctagccaaagtcaatctcagacgtgataatagaagcaataactaaacctaaggaggattttcatgaccgtccgtcgcaaccttattcgtgtctcaatcgccctggttttcgggctcctgtcggccgtcggggtgaacatgttcttggttcacgccaattcctattccagtggcttaaccggggcttcccagttggtccaagccctcttaaagttggcggggatcaacgtctccctctcgcttctggtggcgatctttaacatcccgctcttcatctttgcctggcgggtgtttgggacccactacatcaccttttcggggctcgcggtcctgtttaacatcatcttcttgcagatcatcccctcctaccaactggttaccgatcccctaaccaacacgattgtcggtgggatcttgattggggccggagtcggcctgtgcttcaaccgcggctttaccaccggggggattgacatcgtcaccacttacttgcaaaagaagttccaccgtaacgttggttcgattgccaacatcatcaacggggtcatcctcttgatcaccgccctggtctttggccccagccggatcgtctactccctgattgggatgttgattaccaactacacgatggaccacttcttctcctcgcagctagacgtcatcgtttcgatctacacgaagaacccgcaagccatcgccgaccagctcaaagactttacccacggggcaacgatgattaaggggaccggggtttacaccaaccaaccaaccaccgtcgttcaaatcgtgaccccacgcgggcagttccgccacatccgccaactcgccctcaccgccgatccgtcctcctttatcgtggtggcgcgcgtcgacgtcgaggtcggcaactaccgccacttcacattctaagtttacgcccgttttccttgtagaacgggccttttttgtgctctttttcacaccatttgtgaaggcgattgcatggccaatcgccgctaattatatagcggggcgttgcgttgatttaactaactttccctggtcggcaacttttttctgtcaaccgcttgacatagaaccgaaccagtcgtaaatttagtaaccgtaagtgaataatttcaccaacgagaaggagaataagattatgaaatcaaatgctgctagtgcgactagcaagccggtacaaggccggaccatttcaatgtccgcctccctggcttacttcgccctttcaatcgtcgttaactcgatggggaacgtcttaaccttggtcaccagttcccacatccacccgcaatttttaggatccgcctactggaccgccgccgaaaataacctcggttacgccgtcctaggtaaaggaaattcgatggcgctcttttgggccttcatgatcctggggatgctgacttccgttctaaacgccatcttaatgcacaagtgggactggcaccggattttcgggaacttcttgttcatgctgccgttctcaattttcatccagtggttctccaacatcttcaaccggatcatgcccgacgcccactccctgccgatgatcatcctctacgtcttgatcaatttcttaggggtgaccttcatcggggtggcgatctcgatctaccagcgggtcaacctggtcttgcacccggccgatgacctgttccagatcctgcgcttccgctacttcaagggcaacgccaccttggctatgtgggcttcatacattccgccaacgatcatggctttggccgccatcccagcaatgggcctggccaacttcgggttggggacgatctttgccctcctcttccaaggtgggatcacgggcttggccgataagttgatcttcccgaagttaaagcaccaagccttggaccttgggaactagttgtttgttgtttgattttgaaagcgaggaattatcatggcatttaacaagagcttagcgggttactttgacgatcttcaacacgttggcatcccaaccgacgacctcgacaagacggtcgccttctgggaaaagttgggtttcaagatgaccgggaactttgacactgacgataagggcaaccaagtggtcttcatgtcctacgcccacttgacccttgaaatctggactggtgacggcgccgttaagaagaccggggcgatcaaccacctgtctttaaacacctccgacgccgacgccgcttacaaggccgccaaggccactggcttcacgatgaaggaaacagaagtccaacacctcgacttctgggatcacgggatcaagttcttcaacattgaaggccccaacgccgaaacgattgaattctgccaaatcgttaagggctaatcatacctcctatattcttaattcaggctcgcttcggcgggtcttttttcgtggtgtgctacaatgggaacacgaaaaggaggactggcatggataaccaagaaaaaagcagcttagaacagcgcctgcaaaacggggtttacggcacgcccaagattaaccccgatgagcaacggcgctacttaggtacctttcgggaacgggtttgtttaaccatcagcaacgcccagattaaggagcgctcctggacaaccgccgtcgaaaccgaactaaaaaagggggtggtcacccaggtcttcatcaacggtaacctccccgatcaattgacccacccctacgtccaagtaattgcccaggccggcggcaacttcaccttaaaaaccgacccccagtttaagaccgacccggaccgcttggctttagtgatggccgctgatgacgccgtctaccagtcaccaattgacgtggccaagcgctacccggttccagccgccgctcaagaccagccggcgccccaattatcctggtggcaacgcctctttaaaaagggggggcaggaatgatggaaccccttgcctttcgcatgcggccccgcaccttggacgaagtggtcggccagcaacacttaattggccctggcaagatcatctggcggatggttgaggcccggatgctctcttcgatgatcctatatgggccgccgggcaccgggaagaccagcatcgccagcgccattgccggttcgactaagtacgcctttcggaccttaaacgccgccaccgatagcaaaaaggacctgcaagtggtggccgaagaggccaagatgtccggtaccgttatcttattgctcgacgaaatccaccgcctcgataaggctaagcaagacttcctcttaccccacttggagagcggccggatcgtcttaatcggggcaacgaccgaaaacccctacattgccattaacccggccatccggagccgggcccagatctttgaagtaaaacccctgaccgcagctgaggttggcctgtccatcgaccgagcgctaaaggacccgcaacggggactgggaaaattacccctcgtccttgatgacgacgcccgcacccagttaatcaccgccaccaacggtgatttgcgcagcgccttgaatgggttagagctcgcggcccgctccaccgcaccggcgagcgatggtcaaatttacctcaccctttccgtgatcgaagaatcggtgcaaaagcggtcgctggtcgccgacaaggacggcgacggccactacgacgtcatttcggcctttcaaaagtcgatccgcggctccgataccgacgccgccctccactacctcgcccagttaattgcggccggagacctggttagcatcgcccggcggctagtggtgatcgcttacgaagacatcgggctggccaacccgccggccgtcgaacgggcggtcacggcggtccaagctgcggagcggatcggcttccccgaggcgcggattccgttagccaacgcggtcattgaactctgcctctcccccaagtccaattcggccattgccgccattgacgcggcgcttgcccgcgtcaaccagggcaatagcggcgccgtgcctgatcacctaaaggatgcccactaccaaggggcccaaaagctggggcgcggggtcacctaccgctacccgcacgactaccccgaggactgggtcgcccagcagtacctccccgaccggattaaaaacgatcagtactaccagcccaagcaaaacgggactttcgaacgcgcctttgccaagcaataccgccaacttttggcggcccagcgcggtcagcaacctccccagcgctaatttgaagattggccaagcatgtgctaatatacttatagaagctctgttgtgtacgccttgtctatctagcaggtttgccttacagtcttattactttgggacgagtgcttcgtttagtttacgacatgccttttctcttggtagccgaatgctaaactgccatgtcccacctgtcttacacacaggtcaacactgtcggacaattaacggcacgaacggagcttgatacataccttttaaccaggctagccggcctggcttttttattgggaggaattaccatgctgatccaactgctcaccgcctgtttcaacctaatcctgctaattgaggggggctacctactaacccaccgccaccgcccgctctttaacctccacttaaagggggcggtcccaatgcccggcctctacctcttttggggggtagcgttaatcatcgtggccgtaatcattgaaatcttggccctgacctgctcggtggtgattaccttgagcgcaattgccgtcgcttgtttgcttgaattagcaatgactttaacggtggtccggaccttaatcccctagcttttgtagacttactttgcgtaaaccctttcaaaggtgtagaatagggatagataataaacaagggggtagccgattatgactcaacaataccaacacatcctggtgcccgtcgatggttccaaggaagccgaactagcctttaagaaggccgttgccgttgcactacggaacggtgcagataccgaattgcagctcctgcacgtcgttgacacccgtgccttccaaaacgtttctagtttcgactcgtcaatggtagaacaagtaactaagaccgccaagcaaaccttagatcaatacgttgactacgccaagaagcaaggtttgaccaacgtgtcttacacgattgaatacggtgccccgaagaccctgatctcccgggaagtgccagaaaagatgcacgctgacctgatcatgattggggctactggtttaaacgccgtagaaaggatcttaatcggttcagttaccgaatacgttacccggatggccatctgtgacgtcctcgtagtccggaccgacctcgacaaccaaccgacttcctttaaaaagcactagtaactaataacaacgccccggcctaccagattggtaagcgggggcgttgttttggttattcaactaattgactcaattcttgtgagagcgtctcttgtgcggtgtcgtcttccatgatcttgtagattgaaagggcgacggttaagctttcctgggccacgtcgccctggcctaacttagcttgcgcctggccacgggtcatgtaaagaccacccaataagaagagtgtttgctcttcccggcagatcttaattccccgtccagccattgaaattgcccgccggtactggcctaaacgatagtacaggccggaaatctcgtggtacaagatgatccattgccgcttaccaccgttaagctgcttgtcatcgatcaggtggattgcccgcccgacaaactggagcgccttttcggtgtcaccgcgcttctcgtatgccaaggccatcccgatcgtggtcatggccaagtagatgttggcactggtggtggagaattgcgtcaaaatcagctcaaagttaaagatggcatcatccacttggtcactcgccacttggagcatccccaagaggtagtagtagtgttgcttgtcaaaatcattttgtagcttcttgaccttcacccggttcagcttcttgcgggctccttcaaagtcatggttgactaacatcaaactgatttgatcaaagaagaccgtcattgaaacgtcatcgttttcgatgatccggtccaccggaatgtccaagcgggcacacaaagacgttaaaatattcatctttggaatccggttttgcttttccattaaggaaatggtcgcttgggtacaaattccctcggccaacgccgtttgggacaatccccgcttacggcgtacctgttttaaaacttctccctttaatcgcattataatcacttcttttctgtatcgtatggttgtttgattgctcaactcttttctgattgaactaactagataataacttttttatttatttttatcatatcataaattcggctattacgttactgacttactttataccatcatagggcgcaaaaaccatcttttattgaataaaagcataatcttatcaataatgatttgtgataagttcacattatttatatatatcatccaataattgagctgaaaaccaaatatactctttggattttacttgaaatcatttataactgcaaggtgaaatcacaggattgatggcttttataaagttcgcttagtaactcgcttaacttaatttatcatcagattttcgaaaagtcaaaaaaagaagcagtacaggaccacttcttgggcaaaactagttataacgcttttcgccgaccttttcgacccccagggccttgaagtcgtaccggagctggccttcgtgttcaaattcttcaatcccgagttgaatcagacgatcaatcaattcggagtaactaatccccgaaatattccacatttgtggatacaaggagatattggtgaagcctggcagtgtgtttggttcgcccaggtacgggacgccgtcttcgtctaccaagaagtcgatccgggccatccccttcatccctaatgcttcgtaggccttcagggccatgtcggtgatttccttggctaagtcgtcgtcaacgattaccggcaggtcaaagaccaccccggaagcgtcgacaaacttgttttcgtagtcgtagaattcgtcaccctctggtacccgaatcccccctaacttagaggcaatcggattttcgttccccagaatcgagatttcgatttcccgcgggttcttaatcccagcttcaaccagaaccttgtagtcgtaagtgaaggcatccttcatggccgtctcgtattcctcttcggtatcaaccttgtgaatcccaacggaagacccttgcttggccggcttaacgaagaccaggtcccctagctcttctttgatccgcgaccaggagtattgatccttgttttgcggggtgaccaacaggtacttcgtgttccgaatcccggcttggttcaggatccgcttggtgaggtccttatcaaaggacatagccgaagacgcaatccctgagccaatgtacggcttcttgaggagacggaacaggccttggacggtcccgtcttcacccaggttaccgtgaatcaccgggtagaagaagtcgatttctttaaccgtgcttaaggcggcaatcggggctaatggggcatcgaggtccatcttttggtaggcctcttgaaccacttgatcttctggttcgccatcaaaaatccgctgggaggcttcgttgtcgagcaagatgccatccttagtgaacatgaagattgacacatcgtacttgtccttgtccattccatcgtaaatattgtgggcggaccgcttggaaacatcgtgttctgatgagtttccaccgaacaggagggcaacgtgtaatttcttttctgtcatgatgtgctcctatctattatttaattttcgtacgcttcctagaagcttaagtataacataaatccgttttcattgctcgtcttgatttgactgatttgtaatttggcgggcaataatctccggcaggtcagcgctcatcaacagggcctgcattaaccggcggtagttaaagacctggtgccagccctgttcgctttggggccgttcttgttgcaggtctcgttgccagtcacgtaaaaagaccatgaagtagcggcggtagacggggtgttgattcatcatttcaattaaaaaatcggcaccctcatcagcttcgcccatgatcagtggggccttaagttggcggtaggccactaaataggtcgccattaagaagaccttttcgccgcgcaccagttccctgcgccggcatagttctcccaccaagacggtgtactcaccaaagagctggatccagcctaaccggttaacgtacccccggttatcatgctcccataacatgcctagcgccacccggtcaattaaatcactcaggtctgctttggtcacgaagaaatagccagcccggtcggcatatagcagcgaggcaaggccagtcaccgcgctcacccggcgcacagcgcccttattgattggctcctcgatgtggtcaaacaggatctcccacttttttagcgtgttcattgcgtgccgaagttgatccttggtcaacaggtcattggctaaggccccgttaaagagtaaggtcgcctcaccaaaacgaacggctgggtcctcgttagctaactgcgtcaagagcaactccagttgggtgtcgctaagttcggttagctggtcatttttgaggttgctcaccagttgctctaaaatcgcctgtcccgtttccgtaatggccgggagactaactgtcgtccgccggtgcctttgtaagccccgttgaaatgatgccaaacggggcgccaggtccttaaaggtcttcccttcttttgcttggcggtggagcgctttgatcatttctaacttcggtgccaggtctgtttctttcatcgacttgctccccctttaaaaagtgggtggaaataacctccgttgcaggtagcatgtaagagcgggcgaacggttggtgcgaaccacaccgttcttcgtcctgcttagactctgggcctgcggttatttgccacatttgatgtctaatactcgcgaatacagcaagaggccggggaaaacggagttttttcccggcctccatgtgcgttagttacattcaattcttaaaatccagtcggtagccccgcgctcagcccaaccaacggcccggggattgcgggccaccactgttccgttcaccggtaaggttagatcggtgtagcgccacttagccatcaccacgatcaacggctggttggccaccactttagcgcccacctccggcaaatcccagtactcaacgggcccgaggattcgctgggcttctgtcgttagtgacaggaccaccaccctcccttggtactcttggtgccaagggttcgctaattcacgcatctgatcactccctagtggaagttttggttattactgaacatgtaagaccggtggtgataccgcatcgacataatcatcccgatcccaatcaggttccccactaacgaagatccccccgcggagatgaacggcagcgggatcccggtcagtggcaagagcccgatgttcatcccaatgttttcaaagacgtggaagaggatcatcatgatgaccccggttgaaatgtaggcgtaaaattcgtttttggtgtcaaaggtaacccgaatcatcaggtaaatcaacagtaagtagagtagaatcaacaagatccccccgacaaagccgaagttttccccgatcaccgaaaagatcatatccgattcacgaactggaacgtagaccttcgagttattgaacccggtcccagttacaccaccggaaccgacggccttgatactttgccacagttggtaaccctggttactcgtatcttggtctgggtgcagccaagtatccacccggctgaactggtaggattgaaaaccgaccttttctaagattacccggccggccgtcgaggtcaccatcgccagggcactccccccgaccacggccaagattgaaaaggccgggactaggatccgccaggtcaccccggaaaccagaatcatccccacgaaaatggcaaagaacactagcgaggtcccaaagtcattttgaaacttaagggaaatgaaaattggcaggagccacataaacattttaccaattaaccgccagtcggaatcgaccttgtggaccgggtactggctgttatgggtggtaattacccgccccatcatcaagatgtaggccggcttcataatttcggaaggctgaaaggtaaaggggcccacggcaaaccagcttttggccccggtattaacgtagtacgaccgactataaaagatcaaaatcgcaaacatcaagaagatccccgcccagtaagcaatcggcgccagcttccacagctgttccgaatcaaactgcatgatcacgatgaccattacggtcccgacgaggtaccaggctaactgggtcaccacctgcctgacaacgccactcccagagctatcgtgggaagcagccacgtaaatcgacgccagcccaattagggccaatagaaggacacagaaaatgatcccccagtcaatccgggattcaacctccgtgttgtccgtcttcgcacgttgcattcatcaattctcctttgtcaccatcccgttatttcccgggaaattagggaatggttagtgttggtggaggtggtattgttgcaagatcgtttctaggccctcctcttgggagcgcacccgaaatgacgtctcgtcctttaacattaccgccttaaaccgtccatcatcaggaacgacttccccaatcagccgcttgccaataaagacctgctgtatggcttggttattccgttcgctatcttggacgcttacttcaattgctttttctctttttgacatgtttcacctttactttggttggtttctcttcagagtaaaatggttgggaagcggatcgtatcccccgcgtgcaaaaggctggcaccgtaaaatgcgggccagccccattaaaatcccccggctgtgataccggtcaatcgcttgaagcatgtactccgaacaagttggttcaaagcgacacacccggtacggtcggcgagccgagaaaaaccgctggtaggcgatcaccagagcttttactagcctggtcatttacttgcgcttacgcttccgtttgccgttgttagccgggttggcttgcatccgttccagcaattccccggcccccttggcaacgttatctaatgggtcttgggaaacgactacgggtaccttcaacttctcggagaagagctggtcaatcccgtgtaagagggccgtccccccggttaacataacaccgcggtcgataatatcgctggccagttccggcggcaccgtttcaagaacggcgatggcagcgtgcacgatttggtccagggtatcatgcagggcttcttcaatttcgttctcgttaatctgaatttgccgtggcatcccggtcgcaacgtcgcggccccgtacgtccatcgttttcggttcggctactttcaaggccgtccctaacttgatcttgatttgttctgccgagtgttccccaatcaccaagccgtgcttagccttgatgtattcggtaatatcggtgttcatcttatccccggccatccgaaccgactgggaagaaacgatgtcacctaaggaaaggatggcaatatcgctcgttccaccacccatgtcaattaccatgtttccacttggcttaaagatatccaggcctgctccgatggcagccaccttgggctcgtattcgaggtagaccttaccgccaccggactgttcagccgcttgaataatagccttgcgttcaatctcggtgatgttagttggtgcgcaaatcatgatgttgggcttggacatgaaccccttcacgcttagcttaccgataaagtaggaaagcatttcctgggtaatatcgaagtcagagatcaccccatccttgaggggccgcaccgcccggatgttacttggggtccgccccaccatccggtatgcttccgaaccaaccgccaggatcttaccgttgttggtatcaacggccaccactgatggttcatttaaaacaacgcccttaccctggacgtaaattagaacattggctgttccgagatcaattccgatgtctttagccatgtttttctccttccggttttaaaactatcgttcgttattataccacaaactaccccgagaatcggcgaagtcccttagaggggggcactaatttcaacttgaattccctgcttagccacggcggctaagtaaggagcgattacccgggctacttggtcggtcacctcaacttcgatgctagccgccccgcgcaggctcgctaatagccacattaaggcggccggtaaagccaacggggtcactggccccttaatcgaatcggttggttgccccgagagcttcaggcaccccgcttccacttggggggtcacccccagccgttccaaaacggtcagggctgggcttaagtcatccaagttggttccggctaaggaccgccgcccgttcatgaaagtaaccaggccgagcatgaggctctgatcaattaaagagggcgccaagaagtcatccatcgacaacgcggttggcaacgggtagtgggtcccgatgatccggaccccggttgcttgtttgacaatcgtattcccggcttgctccaggtggtttaataacgaggtcataaaggtcggcgaggccccatccactaagaggtcgccggccgttaacgccgctaaggttagccaacgggctgccgtctgctggttacgaggaatcaaaacgtctcctccgtgcaagagggtgaccccttggatccggacaattcgctccccagccccgtgaacccgggcccccattcggttcagcaagtccgccagggcgactaccgccggtgaatggggagcatttttgatcacggtaatgtcgctagccacaattgccgtcaacatcagggtgatcatcacctgtggatcagtctcttgcaaggaaatcgtggtcccccgcaggttggtggccttaacgattatctggtccgtttggccttctaccgttgctcccaaaatcttcagggcatcaattaggcggggattgaaatcgggggtgaggatcaccttaccctgccgaagcatcaggggaccggcgaactccgctagtgaattatccaacggttgatccgttaaactatgggtggcatcaatcttcagactagtacctgcggtttccacctgcgcaccaatctgctttaaaaagcgggtccctaacgttacccgctcgtttgctaaggggacctggtctaagataaccttcccccgtgacgacagtagggccgccgcttgaccggcgaccaccgcttctggatcgcccgccagggttaccgtcccacttagtcgccccccattttcaactctgatccgcaccatcaatcccccttacagtgaccccaaaatagttgatagggtcgtgaaaaaattagtaaagaaactcgcgcacgcgtacccgatcgcaatcgccactaaaacgatcagcaggggtaagcccgccggtggttggcgaaagaagcgctcgacttcgatgcttttaatcgcacgaaaggcaatcaaaataaagccaatttggacaattagcgtaataaaagtttttaactccgccattcaatcacctcatacaatggctatcataccatagctcaccaccggaaccgaaaccaaaaaataagcttaactaaatttttagcggtcataaaaggtggggaaactaaaaagaccgggaagaaattttactttctcccggtcttttcaattgtcgctgttagacagataacgcggtaaccaactaatgagcgcttgtgtaagcagtcataaaagttggttcccactccccgatagactacttcctgctaaggtgcagccggttaatggcccgccgcaagtgaacttccgctcgatcgagggcgtcagcatccttagcttcccgtgcctttttaattaatgcttcagagcgttccttagcactttgggcccgggcaacgtcaatgtcttcaggtaattcggcacttgaggccgcaatcgttgctacgttaccgtggaactcgataaagcccccgttaacggcaacccgttcgtcttccttgtcgctatcttggtgcttaatcaacagcgcgtcgatggctaacgaggcgattaacggttggtggttggccatcagaccgagctggccgcccgtcgtggtcattaccaacatggttgcgttcccgtcgtagacgattccgtcaggagtggagatggtgacttgaaaagtattctcagccatttaagacccccctaaccttcagctgccgtatccgcctgcatcttctttgccttggcaacagcttcgtcaatcccgccgaccaaacggaaggcttcttccggcaggtcgtcgtattccccatcgaggatggccttgaagtccttcaccgtttcttccagcggcacgtaagcccccggttgaccagtaaattgttcggcaacggcgaaactctgggataagaagttttgaatccgccgggcacgggccacgatggtcttttcttcatcggagagttcgtccatccctaagatcgagatgatgtcttgtaattcacggtagcgctggagaacgtgttgaaccccagttgccacttcgtagtgttcttgccctaccacttctggcgttaaggccgtcgaagttgaagccagtgggtccaccgccgggtagatcccaatctgggtcaggcgccgttccaagttggtcgtggcgtccaagtgggcgaaggtcgtagccggcgccgggtcggtgtagtcatcggccggaacgtaaacggcttggattgaggtaatggaacccttcttcgttgacgtaatccgttcctggagttgacccatttcagtggccagggttggttgataaccaacggcggaaggaatccgacctaagagggcggaaacttctgaaccggcctgggtgaagcggaagatgttgtcgataaagagcaacacgtcttgacccttaacatcccggaagtattcggcaatcgtcagcccggtcagggccacccgcatccgggcacccggtggttcgttcatctgaccataaaccatggccgtcttttccaaaaccccggaagccttcatttcgtagtacatgtcgttcccttcacgggttcgttcaccaacccccgtgaagacggaaatcccgttgtgcccttgggcaatgttatggattaattcctgaatcaaaacggtcttcccaaccccggcaccaccgaagagaccaatcttaccaccacgaacgtatggggcgaggaggtcaatcaccttaatccccgtttccaacacttccgtcgtgttactcaagtcttcatactttggtgcatcgcggtggattggcatccgctgtgcgtccggaccaaattccggtccgttatcaacgggttcccctaagacgttaaagacccgaccgagggtgtcgtcacccactggtacactgatggaggcgtcggtgttttcgacagccatcccccgcttcaaaccgtccgtcccgtccatggcaatcgtccggaccacgccgtcacccagttcaagggcaacttcgaccgtcaacgtcttgtcatcggcttcttggatctttaaagcagtgttgatttcaggtaacttctcgtccaagggaaactcaatatcaacaactggtccaattacttgaacaactttaccagtagtactcatgtgtttcctcctgtattcagaatcattcttgggccgtcatcccaccggtaatttccgtaatttcggtggtaatggccgcttgccgagcccggttgtattgcaactgcaaggtcgaaataatgtcatcggcgttgtcagatgcagaacgcatggcgttggcactggaggcgtgttcggacgtcttagcatccagaatcgctccgtaaatcaagctttccgcgtactgcgggacaagcatatcgagcattccaccatcggaaggctcaatctcatactcacttgccggaagcggaaccccatcgccggccgtccggttaccaatttcctgttcggtttggcgtaaaccatccgctgaaatcggtagcatttgttcggtccggtcctgcgaggagatccggttaacgtagtggctgtaggagatgtacagccggtcgtagacttgatcctggtaaagttggatcgcctgcttaaccacgtcatgtacttcccggtaagttggtacgtcactgacacccgtaaattcgtaggcaacgttcatcccgcgcttcttgaaaaactcggcgccggtccgtccaacggtcaaaaagaccgtgttgtctgcgttaaggccgtcttctttcatcttgtcgagggtggacttgataacgttactgttgtaagaacccaccaagccccggtcggacgtgatgatgaggatgccagttttcttcactggacgtttggagaacaagtcccccaaagaggagtcttgttcgtacttcagtgaatcggcgctatgagatttaaccaggctgaccaaaatggcttgcaccttttcagcgtaaacctggtatgtcttcgtgtggtgctgaatctgattgagcttagcagtggaaaccatttgcatcgccgaggtaatctggcgcgtactcttggttgactgaatccgccgtttaacagcagctaatgaagctggcactaaatctcaccgtcctttctactggtcactgttagttttgggccacggatgcatcttgcttttggtcactagtttgaaaaccagccttgaaggagtcgagggccttgtcgagcccgtcgccataagggagttgaccgctttgcttgattgaatcgtaaaggtcttggtggttggaacgcatgaaggtcgcaagttcgctttcaaagcgtaacacgtcgtctaccggaacatcgtccaagtagttgtgtgccaatgcgtacagggtaaccacctgttgttcaactggttgtggggcgtggaggccttgctttaagacttccatcgtccgttcaccacgatctaggcgggccttggtggcggcgtctaggtcactcccgaactgagcgaaggccgctaattcgttataagaagcgatatcaagacgcaacgtcccggaaaccttcttcatcgccttgatctgagcgtccccaccaacccgggaaacggaagtcccggcgtcaatggctggccgttgaccagcgtagaaggagtcggcatccaagaagatctgcccgtcggtaatggaaataacgttagttggaatgtaggcggaaacgtcccctgcctgggtctggataactggcagggcggtcattgaacccccaccaaggtcatcggagagccgtgccgcccgttccagcagccgtgagtgggtgtagaagatgtcacccgggtatgcttcacgaccaggaggccgacgtaaaatcaaggacagttcacggtaggcgtcggcctgcttggacaggtcatcgtaaatgattaagacgtcgcggccgccaaacataaattcttcccccattgctgcccccgcgtacggagcgatgtacagcaatggtgctgggttagaagcggaagcggaaaccacgatcgtgtaatcgagggcgccaaacttccgcagggtttcaacttgggaacgcacggttgattccttttgcccaatcgccacgtagatacaaatcatgtcttggtccttttggttaatgatcgtatcgatggcaatggaggtcttaccggtcttccggtccccaatgatcagttcacgctgcccccgaccaattggtactaaggcgtcaatcaccttaatcccggtctgcagtggttgggaaacggacttacgttccatcacccctggggccttacgttcgattggacgggtcttgtcggtcttgatgtcccccagaccgtcgattggccgacccagtgggtcaacaacccggcctaacagggcatcgccaactggcacttccatgatccgaccagtccgcttaacggtatcaccttcacggattgcggtatcatcccctaaaataacgatcccgacatcgttactttcgaggttttgtgccattccgtagacaccattttcaaattcgagcaactcaccagccatggcgttttccaagccatcagcacgggcaaccccgtcacctacgtaggtaaccgtcccggtttcttcaacggaaatctggtcctggtagttggcgagttgcttcttgatgagtgaactgatttcctcagttttaatgctcatacaaatctcacctcttcaagttcactgttacttaacaattaaacgccgtatctgttcgattttggtcttgatggacccatcgagggtttggttagcggtttttaccaccacgccccctaagatcgttggatcaaccttttcatttaagacgatttcttgggcgccgaggcgagccgccaaattgtccctcagttgattccttcttgtttcatcaagttgcaccgcggtcacaacttcggcatgaacacgcttgtgcttttcatcataccgccgttcaaactcatcgacgattgcaaccatgtcgctcatgcggcggtagtcaaaggccatttgcaagaggttggcaacgtacttgcttgccccttctttaacctggtcgactagggcctgcttttccttaatgccaaggtccaccccggctaatagtggggcgagacttgggttgtctaagaaaacctggcggacactgacaagctcttgataagtttgatcgagttgaccatcttcctgggctaactcaaagatggcccgggcgtagcggtttgcaaccgtcttttggtcaagtctactcatgctttaccaacccttcaatgtaagtgtcaatgagagcttgttggtcatccgcattcaattgcttgtggatgagcttggaagcaatctcaatagacaggtttgcgatatctttcttggcaccacgaagggcgtctcgccgggcttgttcagcgtccttttgggcctgattcttcaggttttgggcgtcttgttgagccgtggcgatgatttccgcacgttggctttcaccagcctgctttgcgttgtcaataatcgtggcagcttcttggcgggaaccctttagttcttcttgacgcttagaagccagcttttgggcttcttcacgcgactgtgcggcactatcgatatcatttgcgatcttgtcagcccgcttttgcatcatttgggtcactggcttccaagcgaagtgccaaacgagggcggccatgatcagaaatgagaccaggtagaagagcatgtcaccaagatacagttggtttgattccgcaatgataaacatctattgacacctcccttgtaatgaattttttggttaaacgattaactacttgttcattaccaggaaggcaataacgatcgaaagaattggcagggcttcgatcagaccaacaccgaggaacatcgtcccccgcagttgaccggacatttccggttgacgagccatcccatcaagcgtgtgaccgataacaagaccgttaccaacacccgcacctacagcagctaaaccagcagcgatacctgcagcaattgcacccattgtatatatcctccttaaagatatgtggttattccccggttaccttccgagaaatataaaccgtcgttaatgttacaaagacataagcctgaatggccccgatgaagactgagaagccttgccaaataatttctagtggcaggctcacgatcatcgtaggaatcccgtgagagaacgccattccagcaagtaatttcaacagtaattcaccggcataaatattaccaaagatccgcagccctaaggttaggaagttactaaactcttcaaccaacttaattggaaacataagtgagaatggcttgaagtagtccgcaaagtaacccttaacgccttgtcgagcgacccccgcaaagtgtgacagcgtaacggcacacaaggcaagcgtcatggtaactaccggatctgcggttggacttttgacaatttcatgcccgttccagccgaactgaatgatcaaaccaagttggttggaaatgaaaaggaagacgaacaagacaaatacaaagaaactgtaaaaaccactcgtttctgaaggcatttgtccacgcacaatcccgttcgtaaattccacgatccattccaagacgttttggccaccggttggcttcatctgcaggtgccttgacaacccaaataacaggaagaaggtaatgacgaagacgatcgtaccggagatcaagttggtccagttgaaggtcaggccgaatagttcaaaagtgaacgcatcaccgcccatctatattccacctcttttctttataacataatctggtttgtattaatgagctgatggacgaacaaaatcaccactaaacccaatatacaaagactaatatagcattctttaatttagaattcaaagcaatttcaaacttttgaaaccggcaccatctcaattattaagcggcttttgctttccaattccctttgattaaatttttattagtttgacatgttgaaagaccctaaatccgtatcataacggctttaattgtcgttaacgaaaaaaagattggccccgcttgtgcagctccaatctttttttgtgaattgttactcagtttagcgttcgctagccgctttttgtgggagaactaggttcaaaacgatccccaagacggcggccaccgccaaaccagagaattcgtattggcccagttgcaggtacgcgttcccgatcccaatcaccaaaatcaccgaagagatcatcaggttacgcttttcgttaaagtcggtttggtcttcaatcatcacccggagcccagaggaggcgatcaccccaaacaagaggaaggagatccccccgatcaccggggaagggattgattcaatcagggccgatagcttccccacaaaggagaagaggatggcaaaggacgccgccccggctaagacgtataccgagtgaacccgggtaattgccaagaccccaatgttttcaccgtaagaggttaccggaggccccccgacaaacccggcgatgatcgaagccgtcccgtcccctgccagggtgtggtttaaccccggatccttaaagtagttccggtcggtcagttcatttaagaccataatgtggcccatgtgctcagtcatcgtcacaaaggcaatcggggccattgataaaatggcgccccaataaaactgcgggtgatagttaacaaacggaatttgaaaggcaggcagactaaaccagtgggcggacattacgccactgaacttcacgattccaaacaggcaggcaatgatgtaaccaccaacaatccccaagaggatcgggattaagcctaagaagcccttgaaaaacatgttaaaaatgatcgtgatcaacagggttaacatcgccacgataaagtacttaatgtcgtaagtgctcccgttcatggtggcgtccttggcggcggtggcggctaaggacaacccaattaccattacaattggtcccaccacaattggaggcaagatacgatcaatccacgccgaaccgaagcgggaaacgatcaacgacacgatcaggtagacgcacccaacggcgatcgtcccctgagcaatccctgggtagcccgtcgacttcatcagcgccatcatcggcacgataaaggaaaaactcgatcccatgtacgccgggatcttgtggcgagtaattaacaggtacatcagggtaccgaccccggaactaaacagggcaattcccgggtttaaccccaccagaatggggaccaacacggttgacccaaacatggaaaacatgtgttgtaaggacagtccaatccactgcccagtgccagggcgttcatcaacgtctaagacgacgtcccgtcttttctcttccattttcttcctccatacaaaaacgcctttggacatccactgttccaaaggcgcacggcacgaattattcgcgatttgaccgaccctttagaacctcacgggattccattaaaggactcactaaattattcctattctacttgacgacctcgtccttgtcaatcccccggtgcttttgccaaatcatgatcatcgtcgaggccgggacggtcacgatcacggcgataaaggaaatcaaaacggcgatgatctcgctgacaaagatcttatcgttaacgatcgtcccaaaggagtagttaagcccggcaaaccagatgaagagggccaacaaaccaccaaagaaaccgaagaacagcgtgttcaaggttgtcccgataatctgcttaccaatctccatcccgctttgcatgaggcggttatcagacaggtcggggtgctcccctaagatctcggttagcccggcggcaatcgccatcgccgcttcggcaatcgcccctagcgttgacagggccgccgtggtgatgatcacctttaaataggagattccaattgccgttgacatcccctccaagtcgtcgctgtcttccaggccgaacccttgggccatcgcccagtgctcaaccaagtagattaagaccaccaaaaccaagaggaccaccactgaggcccaaaaggcggtcacggtggtgcgtaaatcgtcttcgcccataaagatcgtaatcgctaagatgatcaccccggtcattagggttaccatcattggcgggacgtgaaaggcgatcaggatgatggcaaagaagaggaaaccaaagtttaagagcaacgataaaaaggcggaccagccttgccggccccccacggcaatcatcaatagcatcaaaaccagccccagagcggtaattgaactcatgctgcttccccctttctcccgtacaagagcgcggcaaaggccgatactaacggaattgctaggacgattccgatcccggataccaaactttgaacggtccccaagctcatgttcattgaaaaggtgtagccccaattattcccgtttttaatgtagagaagggccgaagtaaaggtatcggccataaaaatcatgaacaagacgttcacgaggggacccatgattgacttgccgatgttgcgcccagacaagaagagttgccggcgactgatcgtcgggtcaatctcgtgtaactcgtgtagggtcgctacgatgtcactcgcctcatccattaccgcccctaaagaccccagtaaggtctcagccaaaaagaggggccgcgggacctgggtaacgtattgcatcgattcgtaatagattccctggtggtgagtcaaattcatcaccagcaccgacaccaacattgccaccgaagtccccaaaacggtcgctaaaaaggtcgccaccatttttttagtcagtccaagcaccaacaagagcgagagggccgcaaagagcagggctaaaatggaaaaggtcaaaaaggcgtggctcgcctgcatcttcaggtcaatttgaatgacgaagtagaacaagacggcgttgaggcaaacacttaacatcgccagactgccggcccaccccatcattaagaccagcaagaagatcactagccagcccaaaaatactaagaccacgtcacgcttgtaaccggccacgttagccgtcaggtggccatttcgctttgtcaactggctcaaaaagatttgatttcccgggtaataacgttggtccagggcccccgacttggtgtaggtattgttcaccttaaactccttaccggtgtatttcccgttcaacattttgacggtcaacgtttggttaacctggtagtcgacattttggaactcgtcagtttccttttgcgccttcccgttttcaacggccaccacttgggccaacggggccttatacaagtgctggttatgggttgtgaagatcatcgctcccaccccgagtacaattagggcgatgacgagtttatacttcgccttccaccacccagttttccacataatctcagatcctttgcttaaaatcacgtcccctattgtagcgcgggccccggcaataatgactgaattatgaaaagctttagcttattttgaactttagacaaattaaagaggcgaggagaaaacatggttcccccctcgcctcttgctgtattcacgaatattagacacaaattacggaaacagtcgcaaacctacttggtcccgaagaggcggtcccccgcgtccccgaggcctggcacaatgtaaccatcttcgtttaagcgttcgtccagcccagccgtgtagatatcaacatccgggaaggcctcttgaaccgccttaaccccttctggcgccgctactaagcaggcaaacttcatgttcttttcttggcagccccgcttctttagggcttcgatggccattacggctgacccaccggtcgcaagcatcgggtcaacgatgaagagttgccgttccgtaatgtcgtttggcaactttacgaagtattcgtgcggcttcaaggtttcttcatcccggtacatcccaataaagccaattttggctgctgggatcaattcggtcatcccatcgaccatccccaggccggcccgtaagatcggaatgatggctacctttttcccagccaattccttttgagtggttttggcaattggcgtttccacttcaacgtcctttaggggcatgttacgggaaacttcgtaggccatcaaggttgaaatttccttgaccgtttcccggaagaccttcgttccgacccgcttgtcgcgaatcatcgttaacttatgttgaattagcgggtgatccagcacctcaaatttacccatgacaaaacactccttttagtttctttgctattgtaccagtcggggcgccgtccatcaatggtccggcccgcaaaaagtcccctaattcaatgccaactgattgattaggggactggttttactaattggttttcttcagttagtcaaccgggtgcgcctgggtgagggcgtgaacggcttctttcactccagccaaaatggtttggtcgtcagcgttgtctaacgccttgataatcaggctggccacctgcttggcgtcgtcttctttaaagccacgcgaggtgatagctggcgtcccgacccgcagaccggaagtgacaaacgggctgcgttggtcatttggaattgcttccttgttagtggtgatcatcacggaatcgagcagggcctgggcgtccttaccggttaagccggtcttcgttaggtcaaggaccaacaagtggttggccgtcccaccagtgaccacccggatcgtttcggattcgttgaacacttccgccatagccgcggcgtttttcaccacttggccaatgtaatccttaaaggctggttgtaagtcttcgtaaaaggcctgggccttcccggcaatcacgtgttccagcggtcccccttgcgtacccgggaagacggccgagttaaacttcttacctagttcttcagacttggataggatcatcccgccccgtggtccacgcaaagtcttgtgggtggtcgtcgtcacaacgtcggcaaccggaaccgggttcgggtggtaacccgtagccaccaggccggcaatgtgggccatgtcgaccatcaagtaagcacccacttcatcggcgatttggcggaacttgtcccagtcgatgatttggctgtaagcagacgctcccgccacgatcaactggggttggatttccttagcctgagccaggatggcgtcgtaatccagttcctcggtttcgggactgagttcgtaaccgtaggtgtggtaaagcttcccggagaaattaaccttggaaccgtgggttaagtggcccccggcgtccatccccatccccaagatggtgtcgccaggctttaataatgcttggtagaccgccatgttagcttgggaaccggagtggggttgaacgttagcgtaggcagcgccaaagagttccttagcgtgatcaatggcgagttgctccacctggtcaataaattggcaaccgccgtagtagcgcttgccagggtacccctcagcgtacttgttggttaagacagacccctgtgcggcggcaacttcttttgaaacaatgttttctgaggcgatcagttcaatcgtgtcctcttggcgttgttcttcgcgtccgattgcggcccaaagttgggcgtccttacctgcatattccattagcttaattgctcctttcacttgcgtacccatattgtacggtaattacgtttaaattgaaaggttaattttataaacgtacgtaaaagccgaaccattttgggatggtctggcttacatgcgttatttattgagcaaatcccggaagtgggccccacccgccgacttattcaaacggttcatgtaagccgctcccagtccggtcggttcaaacccttggcaaaagatttggtggatctcttcttgattatcaaagtcccggagcccctcaaacaaatgggcgctggcctcttgcactcccgtccccagggagaattgatcggcctgaaccgaccaaacgtgggcgtgaagcacttggtcggtagccattaagcccacctgctccttcgactgggcgatcaccgccgctacttctccccaatcatcagcgggatcgacgatgtagacctgggcgttgggagcgtaatgcttgtacttcattcccggcgccttgggaacctcatcttgtttgacttggtgatggttgatgtcaattgagccgatcaccccttcaatgtcttgcttggtgacggctccaggccgtaagatcaccggttggctcgttgacatatccaaaacggtcgattcaacccccacccgggtcggaccgttatcgataatcccggcgatcttgttgtttagatcgtggtagacgtggttagccgtggtgggactcggtttccccgaggtgttagcggacgggcccacgatcggtacccccgcctggctaatcaaatcgagggtgggctggcaatcggggaaacgaaaggcaaccgtatccaaaccaccagtgaccattttagaaagggtgccgagtttgaaccgtaaaataatcgttaaggaaccgggccaaaagcggtccattaattgcttagcctttgccggaatttctgcggcaaagtgctcaaccatcgctaacgaggaaacgtgaacaatcaacgggttatcactcggtcgccccttggctaggtagacttgcttgacggcttcctcgttagtagcatcggcccccaagccgtacaccgtctcggttggaaaggccaccagttgacctgcttggatcaacttggccgcttgctttacttccgctggttgaaaaatgactgttttcaccattatctttccccttcttatctaatcaaagtctgtcaccttaatcatccgcattcgccccgcaatgtcgtgacgggtctcaattttagcgctcggtgccagttcctttaatagctgctgaattcgttcttcttgtcggtgaccagtttcaccaaacaggaccccccggggcgttaagtgctcaccggcggccgcaaacaaacggcggtaaaaggctaagccgttctcactagcaaacagggccagcggcggttcgtactccaaaacctccggatccatctcgtcaatttcacttagcgcgacgtacggggggttggtaacgatcaggtcgaaacgctggtcccctagccgcgcgaagaggtcgctttcgacttggtttaagttggtcccgtgcaagcgttggttagtcagggcgatcttcaaggcggccgccgaaatgtcactcagggtaacttgccacttagggcgctccaaggccagggtaataccaattaccccgctcccggttccgaggtccaacaccttgagttccttatccgccggcatcgaatccaggacccattcaaccaactcctcggtttcggtttccggaatcaagacgtcccggttaaccacaaacttccgcccaaaaaagggcgccttgccgaccacgtactgggccggttcgctactggcaacccgggtgatcgcccgttggtagcgggtggcttcttctacgggcatcggttgacgattattggccaacaggtcggtcatcgaccagtcgtggagcatttccaaaataaactgcgccgctgatggatccttaccatggtcccctaaaaaagaagaagcccatcgctgggcttgaaagtaggtccaattattactcattgcgtaattgctccagcttttgggcctgatcggcaatgattagcgcttcgatgatttcttctaggtcaccagccatgatcttatcgagcttgtttagggtcaggccaatccggtggtcggtaacccggttttgcgggtagttgtacgtccggattcgttccgaacggtccccggtcccaatcgcgtttttacgttgggcatcgtattcagactgttcttgttgttggtagtaatcgtaaacccgggcctttaaaatctgcattgccttggcccggttttgctgttgggaacgctcgtcttgcattgccaccacgatccccgttggcaagtgggtcatccgtacggccgaggaggtcttgttaatgtgctgaccaccggccccagaagagcggtaaacgtcgacccggatgtcctttggatccaggtccacgtcaacgtcttcggcttccggcattacccccacggtcgccgtcgacgtgtgcacccggcccgccgattcggtcgccggaatccgttgtacccgatgcgccccgttttcaaacttcagcttggagtaaacctggtcaccggtaattatcagggcgatttccttgaacccgccgacttcggtttcgttgcggtcaaccacttcaacgttccacccctgcttttcggcgtagcgaacgtacatgttatacagatcggcggcaaacagggaggcttcgtccccaccagcggccccccgaatttccataatgatgtttttatcatcattcgggtcctttggaattaacaagacttccagttcatcttggagctgggcttggcgttccttggcttcgttaagctcctctttggtcatttccaccaggtcggggtcgctttcttcgcgcaacatctcggtgtcatccttaatcgtttgggtgacttccttgtactcgttgtatttttcaacggtttcgcgtaggctcccttcttcctttgagagcttcatgaaccgttgggagtcggcgattacttcgggatccgagatcaactcgttaagttcatcgtagcggtcggccacggcttgtaacttatcgaaaatttcttccatttccattactcattctcctgttcacttggcaaatctgggtgaaaatagtgttcccggcaaaccgggtagtaggactcgttaccgccgatttgaacctgggcgccttggtaaaccgggtgcccatcgctaatccgcaggttcatggttgccttgcgggggcaaaaccagcagatcgtcttcatctcttcaatcttatcggcgtagatcaacagggcctcggatccctcaaacaactcgtttttaaagtcgtttttgagcccaaaggccatcaccgggatcttgaggtcgtcaaccacgtggcatagttgcagtacgtgggccttactcaagaactgggcctcgtcaatcaaaacacagtaaatccggtgatcgatttgtttgatcagttcaaaaacgtcggtgtcctccatgatcggcgtgacccgccgtttcaaaccaatccggctggcgatcaccccggtgccggcccggtcatcaattccgctcgtcaacaattcaaccggcttgccctgctcctcataattgtgggccacctttagaatgtcaattgacttaccagaattcattgcgccgtacttaaagaacaactgcgccacctgtctcacccatttcttcgcataatgccttaattatagcggatcttgggcccgttttaaactcttctccccccagttagccaatgttttcttgagttaaccatgcttattgccggtctaatcgtgatgaaagcggcttgcttagctctttcctcattgaaaaataattttcgcccgcgccgctagcatgacttggtgagggaggttactttccttttgggcccggaacgattaaaattaatcggtaatcaatacacgcaagcggaaggatatgaattatgtctttaagaagttcgctggccgaatttgccggtcggtctagttactggttcctccacacctttacccacgggggctcctcattaccaggcaagattgtcaccaagctcgatcccaacatcttacaagccttcagtaagaaatacgacctggtgatcctcaccgggaccaacgggaaaaccttgaccaccgccctctccgtccgggtgctacgggaaaagtacgattccgttttaaccaaccccaccggttcaaacatggaacaaggaatcgtcaccaccttcatcacggcgccccggcccaagcaaaagggcttggcggtcttagaagttgatgaagcaaacgtcgtcaaggtcactaagttcattaccccgatcgcctttgtctttaccaacttgttccgggaccaaatggaccgctacggcgaaatctacacgacctacgataagatcttagccggggttaagttagcccctaaggccaccatcatcgctaacggtgacgagcagatcttcaacactaaggagctgccaaaccccgtgatctattacggtttcaaccacgaatcccacgcggatttcaaggcgccggctaataccgatggactcttgtgccctaagtgccaccacatcttgcactaccacttacggacctacgccaacctaggcgactacttctgcccccactgtggctttaaacgtccggaactgacttaccaggtcactaaacttggtgaattaaccccgacctcctcttcttttgaaatcgatgggatcccctatcagattgaaatcggcgggctgtacaacatttataacgccttagcggcctattccttaggtcgtttcctaggggttagcccggcccaaatccaacacgccttcagcgccgacgaacgggtttttggccgtcaagaagtaatcaacgtcgacggcaaggaagttaccttaattttggtcaagaatccggtgggcttaaaccaggtcctggacatgattttgaccgatccggagcccttctcgtttggcttcttgttaaacgccaactacgccgacgggatcgacacctcctggatctgggacggcgactttgaacgcctccacgaccacgatatcccctacttcatgaccggtggggagcgctacaaagacattaccacccggatggaaatggctggaattgacaagatcgatcacttaccggacctcaaccaagtaattgaaaagatcccgcaaatgcctactaagcacgtatacctcttagctacctacacggcggtcttgcaactacgcaaactactagccgacaagaaatacattcaaggagggatggattaatggctaagtaccacttacacctcgcccacttgtacggcgacctattaaacacctatggcgacattggtaacatcatcgcccttaagtactacgctaagcaaatggataccgatatccaagtcgacgtggtctcaattgaagacgactttgatccagatcagtttgatattgcttttttcggtgggggtcaggactacgaacaaatggtggtctcaaaagacatccaaaccaaaaaggacgggatcaaaaagtttattgaggacggcaaaccaatgctcgccatctgcgggggctaccaattactgggtaagtactacgtgggggccgacggggaaaagatccccggcatcggggttttggaccactacaccttaacccaaagtgagcaccggtccgcccagcaaaaccagtcccgcttcattggcgacgtcgagattcaaaatgaagacaccggtgctaagttccacggctttgaaaaccacaacggccggaccttcctgggtgaaaatgagcgccccttggggcacgtcttagcgggccacgggaataacggcgaggacggcacggaaggggccatttacttacacacctactgctcctatttccacgggccaatcctcacccgcaacggtgagctagctaagcaaatgttacttgaagccctttcgattaagtatcccgacgccgatctgacaccccaagaggggctaatcgtccaaccaaccttttagggggtggcgcaatgttaaattcactctccaccctcatggtgatcgcctttatcgtcgagtcattctttgaagtccgcctccaactgtacttacgtggactactggccaacgatgaggcccccgccgaattagagggccgaattcgccggattgtccggatcgacaaccgctggagttggggatcgtggttgttaatcatcttcatgttcgttgccccaggtaactggtcctttctggcagtttgcatcatcaccctgttagaaacgatcgtggtgatggaaatggaccacctcaaagccaaaatcaaaaatagttaaaagtgagtgcgatccaacctatcaagcaggccgtgggctaaggatagaacgggggttgatgcggtacgcatcgttctccggtcagacttagccactaggcctgcggttggggagcacgttattggaagtgcgaccaacctctgattcgggtcgtatagctaagctagggggaaggttggtgcggcacgcaccgttcttcacccgtacttagctactaggcccgtggttgggagcacgttatctgtctaacatttgcgaatacaacaaaaggccaggagaaacatgatgttctcctggcctttattattacaaaattggggcgagtaagcggcagaagtcctgtttgaacttccgccaagctgattgctggtcgaagtactcctcgttcagttgggtgcagtcttttagatcgttttcaaaggccgctttcaattcaccagccaactgctcgttgtaagtaaaggcgttaacctcaaagttaagccggaaggaacggtaatccaggttagccgacccgaccgacgccaggtgaccaccggaaaccatggtcttggcgtgcaaaaagcccttatcgtacttgtaaaccttcaccccgttggaaaccaggtagtgggcaaagtactccgtcgcccggtagacaaaggggtgatccggcatcggcgggatcatgatccgaacgtcgatcccggatttagccgccaccactaatgactctaaaattgcgtcatcgggaattaggtacggggtttgaatgtagacgtagtgacgggccgaggaaatgatcccttggtaaccgcgacgaatcgcccggttatcgttatcggggccggacgaaacaatctgcatcggaaccattgaccgatccggattctttagccggatggttcgaacgttaacgtaatcacccgccaggtccatccgctcctttttggtccgccggcaagtcgtgttccaatccatgatgaagcgggcttgcatcatcaatacggccgtcccctcgacccggaggtggctatcccgccagtaaccaaactttggcgactcgcccaggtactgatcaccaatgttaaagcccccaatgtagcccaggtcaccgtcaatgatgaccaacttacggtgcaagtggtaattcaagcggggggtgttgaaacgagccttagcgctagaaatgaaggcctgagcttggccaccaagttcttcaaggtgactaaagaagcggtaagtggtcccccgcgaccccgacaagtcataaagaacccggacttccaccccacgctcggctgcccgttcaagggccgccaagacccgatgacctaattgatcggccgcaaaggtgtagtattcaacgtggatgtgccgcttggcctgatcaatgtctttgatgagctgatcgaacttagcgtgcccgtccgtaaataaatgtacctggttgccaaaggttagcagggcgttgtcggtgtttaacaagaggttggccatcatctgatccctacgcgattgctcttctttaggcaggagcttttgggcctccagtaggcgctgttgttggtgcttgtactgttctagaatgcgccgttgttcgtcttggatggtgaagatctggtcgtgcgacagtttgcggcccacgaagaggtaggcgacaaagcccaccaccggtaaaaaggataagaccaacagccaggcccaggttgaagcgatgtcccggcgctcccgaaagaccgtccaaaaggccagggctaggttaattaaccagatagtttcaattacatagcgaatggtatcccaagttatcattaattttctcccatttcacgaaggtatgtagcaatgatttgatcgcggcggtctaagtagcggttgtttttcccccgcgggtgcacccggttagtcagcataattagcccccggtcgtgatcacggtctaagactaagagggttccggtgtagccagtgtggctaatcaaaaaacggtgggtggctgggtttgggaccagcttccagcccaagccacggaggtgggggctgaccattctggtttgatcgctaaagagctgcgccatggtttgttcggtcaacaggccggccaggttagtccccaccagggcccggctaaaggtaatcaagtcagtgaggggggcaaaaaagccggccgacccgcagtggctccctaacaccgctcccttggggtcgtgcacttgaccgcgcaagagcccccgccgctggtcaatgctcgtcggcaccgtttgggtggctaccggctggtcggtgatttgcgtcatctgtaagggggcaaagaccaactccctcgccaacacgtggattggttgccccaagatgcgctcggcaatccagcctaagtagatgaagttaacgtcggcgtagcgaatcaagcggtcccggttaaccccactagtctggttcgttaacagggcggttgttaactgcttagcatcaaggtcatcacgatttttaatgtagccaccaattgccgacgaatgggtcagcaaatggtagattttaacctggtcgtttgaaaactccggtaagtacctactaaccgggtcatccagagacaggcgcccgctttgtaagaggatggcgatcaccggtaccgttgccaccaccttggttagggaagccaagtcataaagcatcccagggcgtaaccgttccggagtcggttcaatttgcgctagcccccgaacggcttcgacctgccagtcgcgttcaaagaggcaataagacatgccggggaccaccccgtcgtcgaccattgcccgtaactgcgcttgcgttgtttgataggtttgcaatcaacttcccccttacttttcacccattataccaaagacacccccgtacaaaagcccattttggcttccgaacgggggtgttttaaattgaaccttaaatctgattgccggcaaactgactgttgtacaggtcggcgtaaaaaccgccctttgccattaagctatcgtggtccccggtttcaataatttgaccgtggttcatcacgatgatttgctcggcgctgcggatcgttgacaagcggtgggccaccacaaagctggtccgccccttttggatgtcattcatggcgtcttgaatcgcctcttcggtccgggtgtcgactgacgaggtcgcctcatccaagattaagacctccgggtcggccaagaaggcccgggcaatcgtcagcagttggcgttgcccttgagaaatattggaggccgattcgtccaatacggtttggtaaccattgggtaattgacggatgaaggtatcggcgtgggcctgtttggcaaccgcgtagacctcttcttcagtggcatcttcacgaccgtacttgatgttgtcgtaaatcgtccccgtaaacagccaggtatcttgtagcactatggcaatcttcttgcgcaattccggccgcgtaaaggaacgggtatcgcgcccatccaaatagatgtggcctcccttgacgtcgtaaaagcgctccaagaggttaataatcgtcgtctttccggccccggttggccccacaatcgccaccatgtgattctgctcggccttgagattgaagtcttgaattaacggctggtcatcgtagctaaagttaacgtctttaaactcaactttgggctgtggccccggcaagacggtttgatcagccaagtcagtgtccatttcgtcttggtctagcacctcaaaaatccgttccgctgaggcgatcgtctgctgaatggtcgaggccaggctagcaatctgggtgattggctgcgagaactgattggtgtattgcaagaaggcctggacgttccccagggtaatctggccgttcaccacttgcaacgccccgaccaccgcaaccatcaagtaacccaggttccggacaaaggccatcgctgggtacatcaaaatggagaagaactgggccttccaagcggcttggtagtaggcggtgtttttttcttcaaactgcgcttcttggtccgcttcccggttaaaggtccggacgattgtgtggccagcgtaagtttcttccacctgcgcgttaatcttacctaataccgcctgctgccggacaaagaggcgctgagccgttggtgccacaaagccaataatcactaatgataatggcacggtaattagggcgactaaggttaacttccacgagatcgaaatcatgagggccaatacccccacgaaggtcagggcggaagtaatgatttgaatcatcccgttttggagggtaccggagatgttatccatatcgttaaccatccggctcatgatgtccccgttgggatgggtgtcgtaaaaagagactggtaaccgggacatcttagacttaaaatcctgccgtagttggtaaaccacccgttgcgaaatccgggtcatcatcacttgttggacgaaggaaaataagcccgacaatgcgtacatcactaaaacagcgatcacaatttggccaatcttagtgaagtcaatcgggtacttgcttaggtgcatccccagcttcatttcagacgcccccttcaagacgccattatagataaccgttgtggcctcccctaacaccttgggggccatcacttgaaagaccaccgacgcaatcgcaaccaggatcgaaataatcacgccccacttccaaggcttcaaataagtgagcaaacggcccgtcgtcttccaaaagtgttgtaccttggcgccgtctttttggtgtctatttccgttgtgcacgttcttcatccccctcttgaatctgcgagtgcagaatttcttggtaggtcttattagtggccttgagttcttcgtgactcccttggccgaccaccttaccgtcatcaaccactaaaataaggtcggcgtcggccaccgttgaaattcgttgggccacaattactgatacggcgcgctgaatttgcgggtctctgcgcaaggcttggcgtaacttggcgtcggtcttgaagtctagtgcggaaaaggagtcgtcaaagatgtatacggaagccggtttaataattgtccgggcaattgccagccgttggcgttgtcccccggagaagttactcccgtcctgttcgacgatggtatctaagcccccctcttctctaacgaagtcggcagcttgggcaatctctagtgcccgccacatatcgtcttcggtcgctgtttcataaccaaactgcaggttggaacgaacggtcccggtaaagaggaccgccttttgctgggtgatcgagatttcttggtgtaaatcatgttgactcaagcggtcgatcggttgaccgttgacctcaatccgtccgctttcaacgttgaaaaggtgaggaattaagttaaccaacgaggacttacccgaaccggtccccccgataatggctagggtttgtccggcttgaaccttaaagttcaggtcggtcaaggccagttcctcggctccttcataacggaagttaacgtgatcaaaagttaggctggctggtgcgtccttaaccacactcagttgttcatccggcgtggggtcactaacgctagggcgccgatctaaaacttcatttaaacgggcagctgaagctgaggcccgtggaataaagacaaacagcatggacagcatcataaaggacatcaggatctgggtcgagtaggtcataaaggcgatcaggttccctacttgcatgctcatgttagcaatcaacttggctcccacccagataatcccaatgttagttagggaaaggattagagtcatgattgggaagagtaacgaaaccagggtgaaggccttaatcccggtgttggtgtaatcggcgttggccccttcgaaacggtcttgttcccgctggtcctggttaaaggcccgaattactcgcaccccggtcaagccttcccgaaagaccaggttaatccggtcggtcttcttttgaatactcttaaagagcggaacggcaaagtacatcaccccaattaccacgatggcaaggaccggcaaggagatggcaaaaactcccgttaagcgcggctcgcggtggtaagccaggatgatggctgccaccaacatgatcggtgattgaagcatcatccgtaaaaactgaaccatcacgttttgaacctggacgatgtcgttagtcgacctagtgattaaagacgaatcaccaaagtcagacatctccttgctcgaaaaggttaacaccttgtgataaatttgccggcgtaacttttgccccaccttcattccctgggtggaggcgaagtaaacgttacaagccgaggctagcaacccgagggcggccaccaagagcattatgccaccttgttgccaaatgtaggccatatcatggttaatcacccccttatcaattaagtccgaggtgatggtcggcaggtacagatcggccgccacccgaaccaataagaagatgaccgccaagagggccggcaatttctctaggttgcgccgtgcgattctaatcatcgaaaaactcctttcgtgcgttggtctcaccatagtggtcaattaatgcttggcgaagcttgattgcaatttgataagtttgttcacgttccgatggcgtaagcggacttagtaactgttgaccaaaccgctcccggtccgcctgaaccttagcccattgctctcgccccgcttgcgtaatcgccacccggataatccgcttgtcgtggggatcacgctttctggtgaccaaaccctggcgctccaatttttcaattgctaccgttaacgaaccgggtttgatgcttgcttcatccgctaattggcgttgtgacaagtccgcttgtttattaagcgactcaaggatccgtgccgacccatgaaatcccgccgccttcttatgtttaatcaccacgtcacgaatttgcataaataagtcgtgatagctttgaaagatctcctcatcacttaccactagtccccctcctcaaaatcgttagacttataatcattagacttctaatgattgttagttttactcagattctcccttgcgtcaactaatttaattcctcataacacaaattcaaaaatacattttgtgatattcttgcttgcgatatgtctcgctcttatctgaataagatgacatttaatcttatcaacaatatagctaatatagcaaaagcagcttaaaacattcacaaagcagaattttaaaataacaccggagaaaaatatttttaactactaataaacacgtgaaattaagctcaattggcgctaaaagcaaagtttttctcgattaagatcaaataattatgcaatccagggcttagcatcaatcgcttgcaatacaaaaacgtaaaatcatgatagaatgagcgaatagagtactgctgaaaggaggcgataacatggcaactacgcgcattgacgttaagcctgctgtcttgcattgggttcaagaagcatctaatggtaccttgaatgaggcatggacaaataaaattgataaatggatcaaaaatgaaagtaagccgaccctaaatcagcttaaagatttaagcaaaaaagctcagattccttttggatatttctttttggataattggtcccctgtcaataaaatagacaatttaaatagagacttttttgtcctatgccacgactaaattttgaatttgagtttgatactcattttcaagttgctttggtgatttgaatcggttatgtccgtataattggtgtaaattctaaataggactttgtgaaatctgaaaggaacttcattaacaaatatcagaataaggtaagccactatggttctaattcggtggtaaacttagatgaaccggtaatattctagtattatcagtagtgcgaacctaaagtgaacataaattctttaaggattcgcaccagaattttggtgattttattcaaaaatcacactaacagttggtttttcagctgtttgacacccaatatgtagaagatggagttctctatttgctatatattgctgtcgcactccttcgcgggggtgcgtggattgaaatgtcttagcgatcgtattgttactgacgaaccagggtcgcactccttcgcgggggtgcgtggattgaaataccccctccctcaataaaataaaccgaaggaaggcgtcgcactccttcgcgaatgtggctattgatgatcattttattgatctactattcccctcgaatcttcatatacatggttaagactttctttgagttcatcctagtaatttctgaaatgggttattgggtctacaaaaagggaaagtggatccatgaccactaaaaaaacagttgtgataccaaaaagccgccagccccattctccggggttagcggcttatcttcgtttagcggtcttcaataaccacgtaggtgcattgaaccgggccgtggaccccaaccacgagttccatttcgatgtccccggagtttgacgggccggagatgatcgtgatcgcagacgtctttaagccctcagcgaaacggtgctcatagttaaccatcgcctggcgggtggaacgaaccaggccgctttgtggaaccagggcaacgtagtgggtggggaggaagttaaacccccggcccatttccggtcggttaaccacggtcaccgaaccggtggcggcgatcaggtagtcggctaacccgatggcgatgtcggcctggtcggcgttttgttcgttttgatcccggtcaagggtgggggaccaggtggcgacgtgctcgacccccgggttttgcgcccagccgtcgagttggtagtcggcccattcgctggcgtccaaccccggtaacaagaggcacttggcctggtcctggtgggctagctcggtcaggtagtcagccagctcggcgctcgacttaaccaccagttcggcgttgacgctctcgctgttttgcttggcggcgtccagcaactcagttggggttaggtcggcgagcatttgttccggtaggtcgttgagcggtttaaaggggtggtcggctaattgatggcgggaacgccccgactttttagccagccggtctaagaaggcctcgcggttagcctggttgtttgcttggtctaataaactagtcatgttcggcctcctctaggtgttttttgacggccggggccaccgcggttggctggtggtccttaaaccagtgacggaagttgtcctttttcttgcttggcatcggtacgtcccgggagtcaacccagccgtggatcagcttcggcgtgatctttggcacgtggttaatcttaccgccctcatacatcccttccacgtcgcccggggccatttgcttggcaaacatcccggcgccggggtgagcgaaggtcaaagcggattggaagaggaacggtgagccggtaccgatcccgatcaccttgaggatcaagttggtcatcgacttgtccatgtgcttgtcgtccatttcgacgatccggtgcttgcggatcaggctatggagcgggatccggaccgggcaggtttcggtgcaggccccacacagcgagcaagcataggggagttcttcaaacttctcgtagccgcccaggattggggagaggacttcacctagcgggccggggtagatggaaccgtagccctggccaccgatgtgacggtaaaccgggcacacgttcatgcaggccccacaacggatgcactgcagaatcggttcaaattcggtccccagggcgtcggaacggccgttatccaagacaacgacccagaagtcttcggggccatcgacttcgcccgccacctgcttgccggtaaaggtacagtaggtggttagcttttggcccacggcggagcgggctaacatgttgtccaagacctcggcttccttcatggttggcaccagccgttccatccccatgacgaccacttgggtcttggggatcgccatcgttaaatcggcgttcccttcgttggtgtctaagttgatcatcccgttgctggcgatcgcgaagttacacccggtaattccgaagtcggcttgcatgaagtacttacgcaggtacccccggacgaagcgggcctcgtgttgcgggttgttatcgccgtcgtagccaagcttttggaattcgcgttggatctgatcccggttcttgtgcagggtcgggaaaacgatgtgggtgggttcgtcccagttgtcttcttgcaagatgaattcggccagatcactttccaagaggctggtccccggaatcgtcaacagggtcttatcaaggtcgatttcggtggttaccatcgacttggacttgacgatctttttggcctgcttttcgatcgccagctccttgatgaagttgcgggcctcttcttcggtttgggcgaagaaaacgtgacccccctggcgctcgacgttgttggaaaattcctccaggtagtcgggcaggtacttgatgacgtgctggcggatctgttcggccaggtcgcgccactcgttccagtggcccatttcgcgccgggccgccgtccgcttgacgaactgggcgtcttgggccttggcgacggccgcccgcatgaacttgtcggcttcggcctcttccacccgcgtcatgtatggcttatcactcgttgaaattcccatttaaaagaccccctctccgctagccggaaccagctcttcgtcggtgtcggccaggtaggtgatccggttgacgtcgacgttgtggttcaaaacttcggcgatgtgcatgaccttgatgtgatcaccgttacgattcatgtaaccggcgatgttcatcaagcaagacggctccattccaatcaaaacttctgcttgggtttccatgatgtcagcggccttttctttgaccatttcatcggataattcggggtgcttggccgagaaggtccccccgaagccacagcacagctggacgtttttcagtggcacccgttgaatgtctttgacgtggtctaataagacgaagggcgccgtccgttcacccaacaagcgggtcatgtgacaggaccggtggaccgtcaccttggcgtcgagttcggccccgcagtcaacgacgccgaggacccggtaaataaactgggtaaactcgtaaatcttggcggccgcttccttggcgcggggaccgtaaaccgggtcatcagccaaaatttccgggtattccttgatcatgaagacgcaagagccggtaggacccacgatgtaatcggcatcgatactgagtagggcatcaatttcgtttttaaaggttttcatgctgcccttggagtagccgctgttataggttggttgcccacaacaaacctgctgttcgggcaaaaaggtctcacaccccagccgctccaaaacctccaccatggcttggccgacgttaggaaacatcaggtccaccaggcaagaggagaaaatacaaactcgcggttgtttcattcgttacgcttagtcagcaccctggctaagcttccccctttcaatcagttcgcttaccttaatcgtaagcgctattttcataaataataattaggagaaagtcctaattacttatcgttcggtagttatagtctggggagtcctttcttgctaattagcgacgaaccgtggtagcatttgatggttaaaagatcggcgccccgctgttaacgaggaccgagcaaaaaattcatttaaatgggggtttcactcgtgaaaatcgggattgataagttggccttcgccacgacaccttactacttggcgatggaggacctggcccagggacgcaacgttgacccaaataagtatctgattgggattgggcaaagcaagcaggcggtggttccaccgacccaagacgtggtgaccttagcggcggcggcggccgacaagctcttggacccggttgaaagggatcaggtttccaccgtgatcgtggcgaccgaatccgggattgataattccaaggcggcggcggtttacgtcaagcacctattgaagttaagcgactttacccgggccgtggaagttaaggaggcctgctactcggcgacggccgccttgcaatttgcccgtggtttggtggccctcaacccccaagaaaagatcctggtgatcgccagcgacatcgcccgctacggcctggaaaccggcggcgaggtcacccagggggccggggcggtggcgatgctaatcaccgccaacccgcgggtcctggcaattgaaccaaccagcgtcgcctacaccaaggacgtgatggacttttggcggccactgtacgccgaagaagcgctggtcgacggcaagtactcgaccaacgtctacatcgactttttcaagcagtgctggacccgttaccagcagctggccggctacgggctagaggacttcgccgcgttggccttccacttgccgttcaccaagatgggcaagaaggccctggaggcggaattaggcgaccgggacgaccaagtggcgacccgcttgcgggctaacttgacggccggccaggaggcttgccgccaggtcggcaacctctacaccggctccttatacctgggcttaatgtccttgttgacggaaggcgacgttaaaccgggcgagcggatcggactgttttcctatggttccggagcggaaggcgagttcttcgccgggatcttgcaaccgggttaccaagaaggcctgggcgatttaaacgagcagttagccgcccggacccaggtgagcctggccgaatatgaagacctcttcaaccaacagttaggtttaaaggaagaagacgtcacctttaaaacgccggcggctggtcaacgctttgttttggtggggcaaaaggaccaccagcgccagtaccgggacctagccgagcgggattaataaataaaaatgcggctggaaagcgggttgctttccagccgcattttgagtttgaagtggggaatgagggctcaacggcctgtcgagaaggttgggtcgcacttccataacgtgctccccaaccgcaagcctagtggctaagtacggctggagaacgatgcgtgccgcatcaacccccgccctagcttagcccacggcttactttagaggttgggtcgcacttccataacgcgctccccaaccgcaagcctagtggctaagtacggtcggagaacgatgcgtgccgcattaacccccgtcctatccttagcccacggcttgctttagaggttgggtcgcacttccataacgcgctccccaaccgcaggcctagtggctaagtctggccggagaacgatgcgtgccgcatcaacccccgtcctatccttagcccacggcctgcccgatggttgggtcgcactcacttcctttaaaaaatatcatcccgaaagaggccgaccaccttaccgaggatggtgacgtcgtccaaaataattggggccaacgtgtcgttttccggttgcaagcggatgtggccctgttccttaaagaaacgcttgcaagtcgcttcgttatcgctggtcatggcgatcacgatgtcgccgttattggccgtttcctggcggcggacgatcaccttgtcgccgtttaggatcccaatgttgatcatcgacgtcccctgaatggtcagcatgaacaagtcatcgtgatccgggatcgaaggcggaatcgggaagaaatcggtggcgtcttggaccgcaagaattggttccccagcggccaccacccccaggagggggatttgggtttgcttaggggtgattcccaggacttccagcccagccggggtgatttccagggcccggggcttggacgggtccttttttaggtagccctttttgatcaggcggttgatgtggccgtggaccgttgacgtggaagagagccccacggccccgcagatttcccgcacggtcggcgggtagccgtgggcgtcaacttgcttatgaatgaagctgagcacggccatttgtttgttggtggaattccttggcatgtttatttcctccgtattattgtgacctttattgcatattttaacataatgaacgggcgtttgtaaaacgtacgttcgaaaggggcgctccaacttgaaatggggcaacggattgggtagactgagaggcaaacaagtaaaaaaggggtagcagaatggcagaatcacctgaacaagatcgcttactcaagcggatcaatgaattagcccacaagaacaagaccgagggcttaacgaccgctgaaaaggccgagcgcaaacgcctacgcgaccaatacctgaagaacttccgggcggcctttcgcagtaacatcgaaatgatgcaaatctttgataagaacggcaaggaactcacgccggaaaaggttaaggaaatccaacgtaagaaggggctccgcgacgactaggctaaaaagaattggtcaagcgggtcggtttgtgcaataattaagagtattgataaatttaaggggggaaatcaccgtgggtcttactattgccttagtaatccttgggatcctggttggggcattgatcggcttcttcggggcgcgccgttacatggaaaattaccttcgtaacaatccgccaatttccgaagacatgctgcggactatgatgcttcaaatgggccaaaagccgtctgaccgcaagttgcaccaaatgatgcaaacgatgaagagtcaggctaagcgtgccaaccgcaagtaagtgaaaacaaaaaaagggctccagcactgctcggcaagaccgaacggctggggtcctttcatattagttagtcttttttcgtcttttttggtactacgtaatggtaggttgggtcgagttgcttatccagggcgtcaaaggcagtttggagttcttgttcgacctgggccaggttctcttcggtcagcttcatcttacggtcaatgtagattggcttaccaatggccaccttgcggcgttggcgcttgaagaggtccttgaaaaagagcggcccctggtagacggccggcacgagtggcacccccgccatcttggcaatcatcacggcgccgccctttaatttagaagagtagcgcgaccccgaggggaagatgatcgtcgacaggtcagtcttttttaacatcgtgaccggctttttgatcaccgagggacccgggttcttccggttcaccggaaaggcgttgagcttgcgcaagaagtagttggcaaacttgcccttaaacagttcttctttggccatgaagcccagttttttggggtaaacggccagggccaaaaagatcgggtccatccaggtgcggtggggggccaccaacacgtagttgccctccggtaggtccactttgttagcaacgatttgccgcccgttaaacagggagatcaagggaccaaagaagtggactaaaaaactatacaacattgtcattcacctttatttaagctagattaagtatcggttatagtatgaagaagaattcgtcaacttgcaagttggattcaagagaggtgtggagcatggaacaagaagtgacgttaaaagctggcgaacggatcgaccagttatcgagccagggggttcagatcatccaatcaagcgaggtctttgccttctccctggacgcggtgttgttggcggcctttgtacgacccagccagaagcggcgggccctgttggtcgacctgtgcgccggcaacggggcggtcggcctctttttaaaccggcgctttgccgggcaggtggtggaagtcgaactccaacaacggctggctgacatggcggaccgctcgattcaattaaatgacatggcggaccgctaccaagtaattaacgccgacgttaaagacgtctaccagtacgtggccaaggaccaagccgacgtggtggtgtgcaacccaccctattttaaggaccaaccggcgagtcaaaaaaatcccaacccctacttggcgattgccaggcacgaactgaccattgacctggcaacggtgtgcgaccggatgagtgggctcttgaaaatgaacgggcacggctacttggtccaccgccccgaccgtttgaccgagattttagcgaccctggcggaccaccggctcgaacccaagcggatccagtttgtctaccccaaaccgggaatggacgccaacatggtcttaattgaagtgatcaaggacggcaagaccggcggcagcaaaatcatgcccggcttcttggtggccgacgcgagcggcgaatacaccccggcgatgaagaaggccctgtatgagtaagccttactacatctacgtcttgtactgtgccgaccagaccctgtactgtggctttaccgatgacgtaaaaaaacgggtggccacccaccaagcggggaagggcgccaagtacacccgggttaaaaaacgccaccccctgaccctgctctaccaagaagaattcgccgataaatcggccgctttaaaggccgagtacgcctttaaacaccagtcgcgccggcaaaaggaagcctatttactcgcccatggcgtgagcccggaaaaactgcaggggcgcttttgatttaatccttgcccaaaccgcaatgattgggtataatggttttcggtgttaaatccataattcacacccatccatgatggttcgggaagtgccaattggtgcccaagccgtgcgagtgaatggggaggaaaaaactatttggagggattatttatgcctgttgttagcatgaagcaattgcttgaagccggtgtccacttcggtcaccaaactcgtcgttggaaccctaagatgaagccattcatcttcacggaacggaacgggatctacattattgacctgcaaaagaccgttaagatgatcgacactgcctacaactacgttaaagacgtggctgccgacggtggggtggttctctttgttgggaccaagaagcaagcccaagattctatcgaagaagaagctacgcgtgccggtcaatactacgttaaccaccgctggttaggtggtaccttgaccaactggaagacgatccaatcccggatcagccgtctcaaggaactcaagaagatggccgaagatggtacttttgaccgtctgccaaagaaggaagttgctgttttaactaagcaacgcgaaaagctcgaacgcttcttaggcgggatcgaagacatgccacggatcccagatgtattgtacatcgtggacccgcacaaggaacaaattgcggttaaggaagcccaaaagcttcacatcccgatcgttgccatggtcgacacgaacaccgacccagacgacatcgacgtaatcattccttctaacgacgacgcaattcgggccgttcgtctgatcactgccaagatggctgacgccgttatcgaaggcaagcaaggcgaagacgaccaacaagttgcccctgcagaagacgtagctgaagaagtttctgacgaatccttacaagatctgaagaacagcgtcgaaggcaacgactaacaaaatagttaatacttaggctgttttgcaaaaggacctatctggcctgagtgcaaagcggccttttttgaaaattaaggagagattctaatggctgaaattagtgcaaagcaagtgatggaactgcgcaagaagtccggtgccgggatcatggacgccaagaaggccctcgttgctagtgaaggtgacatggacaaggcaatggattaccttcgtgaaaaggggatcgctaaggccgctaagaagagcgaccggatcgccgctgaaggtttgactgacatcgtggtgaagggtaacaccgctgcgatcgttgaactgaactccgaaactgacttcgtggccgcttccgacccgttcaaggccgttttgaaggatgttgctaacctgatcgttgacaacaagccggccgacgtggaagccgccctggaattgaagacggctaacgggacgctcaacgatgacctgatcgccaccacccaaaagaccggtgaaaaggtaagcctgcgtcgcttcacgatcgttgaaaagaacgacaacgaaaactttggtgcttacctgcaccaaggtggccggatcgccgctttaacggtggttgaaggcgctgacgaagcaactgctaaggacgttgcaatgcacgttgctgccgttaatccagaattcctcgaccgcagcgaagtttccgacgaacgcctggaacacgaacgcggcatcttcaaggaagaaactttgaacgaaggcaagccagctaacatcgttgacaagatcgtggaaggccgcctcaacaagttcctctcccaaatctgcttggcagaccaagactttgttaaggacccagacctgacggttgaaaagtacgttgattccaaggacgggaagctcaagtccttcatccgttacgaagttggggaagggatcgaaaagaagcaaactaacctggctgaagaaatcaaagaacaactgaacaagtaattatcggttgaccgtggggggcgtacaatttcgtacgtccctttgtgcgaaaaacaggacccagaccaggaggatatggaatggctgacgtaaaatataagcgagtagtattgaagttaagtggggaagccctcgccggtgaccaaggctttgggatcaaccccccggaattaaagacggtggcaaaggaactcaaggaagtttacgccctgggagttcaagtagcaatcgttgtcggtggtggtaacatgtggcgcgggatcaccggtgaaaagctggggatggaacgtgcccaggccgattacattgggatgctcgggacgatcatgaacgccctgtcacttcaagacgcgctggaagggatcggggtaccaacccgggtccaaacttccattgaaatgcgtcaaatcgctgaaccatacatccggcgcaaggccatccggcacctggaaaagaaccggatcgtgatcttcgcgggggggacggggagcccgtacttctcaacggacactaccgctgccttgcgggccgccgaagtgaacgccgacgccatcttgatggctaaaaacggcgttgacggggtttactccgccgatccaaacaaggacgaatccgccgttaagtttgaacgactgacccacatggacatcatcgaaaagggcttgaacgtcatggactccacggcctcgaccctttcgatggacaacgacattccgctagtcgtcttcaacttgaacacgcctggtaacattttgaaagtggttcgcggtgataagattgggaccacgattgagggggaaaaataatgactggaaaagaaatcctcgcagaagcaaaggaaaagatggccaagtccggtgatgccttgaagcggaccttagccgacattcgggccggccgggccaacgcgagcctcttaaacacggtaacggttgaatactacggcgccccgacgccgcttaaccaactggcatcgatcacgatcccagaagcccgccaactgttgatctcgccgtacgacaagacgaccttaaaggacatcgaacgggccatttacgaatccaacctcggcttgacgccgcaaaacgacggggaaacgattcggctggtggttccgcaactgaccgaagaccgtcgtaaggaactggttaaagacgtgaaggcggaaatggaaaaggccaaggtggccgttcgtaacgttcgtcgggaagcgatggacgacctcaagaaggggaacaaggacggcgacttcaacgacgacgaattccacgacctggaaaagaaggtccaagaagaaaccgacgccggtatcaagaacctggaacaaatcgccgctgacaaggaaaaggaactgttggaaggctaagcagttttggctcgccagctaaccccgcggggtggccggcgggcttttttcgttacgaaggtgagtagccccccgccctaatatctggtaagatgttgatgatgcgaaaattttctgaaatggagaatgaagatggattcacaaaaacaagtggaaccggttggtgagccggtgttagaccggagccgggttccgcaccacgttgccattatcatggacggcaatgggcgctgggcccagtcccgccacctcccgcgggtggccggccaccaacagggaatgcagacggtcaaaaaggtaaccatggccgctagcgacctggggattaaagccttaaccctctacgccttctcaacggaaaactggaaacgcccctcaactgaggtcaagttcttgatgcaactgccaatccgcttttttaatacctttgtcccggacctggtggcccataacgtccgggtgatggtgatgggtgacaccaccaagttgccggcggggacccaaaaggcggtgcaaggcgccctggatgcgaccaaggattgcaccgggatggtcttaaacttcgccctaaactacggcgggcgtgacgaaatcgttcgggcgacccaggcggttgcaaagcgagtcgccactggggagctaaccccggacgccatttccgaggagttgatttcccgggaaatgatgacggcgccgctcggtcaattcgccgaccccgaggtgattatccgcaccagcggggaagaacggcttagtaactttatgctctggcaggcggcctacagcgaattagtctttgttgacgaacactggcccgactttgacggtgactccctcaagcgggccttggccaccttccaatctcgtcaccgacgcttcggtggcttaaataataagtagaaacgaggtaacgtatttgaaaacacgggttattacggcggtgatcgccttaattgtatttatcccgctgattatcgtcggtagctggcctttgatgctggctgccatcgtcttgggaatggtcgccatgagcgaactgctcttgatgaagaagatgtttttgatctcctttgaggcgattatttcctacctgggggtggcggcgatgatcgtgccccagacctggctggactttttgccggagcaaattggccggctcaccctggtttacgtaatggtggctcttctactcttacacaccgtcattcgtaagcaacggtttaactttgacgacgccggggttttgaccctcgggatgctctacatcgggatgggctttaacgcctttaccgttgcccgggccgtcaacttccaaaccctcttgtacgggatgctaattgtctggttaaccgactccggggcctacctgtttggacgccagtttggtaagcacaagttagccccgaacgtcagccccaacaaaacctgggaagggtccgtcttagggacggtagcggcgaccgtcattttggccgtctacttgaccttcttcccggttggttacgacaacttagcggtcatgatcgtcttgaccctgcttttgtcaatcctcggtcagttcggcgacctggtcgaatcggccctcaaacggtactatggggtcaaagattccggtaagatcctgcccgggcacggggggatcttggaccggtttgattccatgctactggtcttgccggccatggcgctgctgggcattctctagtctagcgaagggagtgattctttgatcatcaccatcattacttttatcattgtcttcggaatcctggtgctcgttcacgaattcggccactactactttgccaagcgggccgggattttagtacgcgagttttcgattgggatggggcccaaggtttggtggcggcgttcaaacgggacgacctacaccatccggatcctgccgcttgggggctacgtccgcctggccggggccgatgaagatgaagacgaactccgtcccgggacgccggtgaccttgcaaaccaatgaggaaggcaaggtgaccctgatcaacgccagcgaaaaggaaaccctgttggaggggattccgctgcggatcgttgacagcgacctggaggataagttaatcatctccgggtacgaaaatgatgatgaagaaaccgtcaagacctacccggttgatcacgacgcgacgatcgtcgaacgggacgggaccgaggtgcggatcgcccccaaggacgttcagttccaatcggccagcttaccggcacggatgatgaccaactttgccgggccaatgaacaacttcatcttgtccctgctggtcttcatcatcctgggctttaccctgagcgggatccccaccaactccaacgttttgggcggggtgaccaaggattcggtggctgccaaggccggcctggtgagcggcgataaaattaccagggtggcgacgaccaaggtcagcacctggaacgatatttcccaggcaatttcccctaacccggggaagaagctcgccgttacctaccagcgcgatggcaagacctaccacaccaccgtgacgcctaaggccaccaaacaggggagccaaacggtcgggatgatcgggatcagagaagaggagaagtttgatccggtcgcccgcattaactacggctggcgccaatttatcaccgccggcaccctgatctttgcggtgctcggccacatgattacgcacggctttagcttaaacgacctgggggggccggtggcaatttacgccggcacctcgcaggccacctcgttagggattaacggcatcctcgccttcttggcgatgctgtcgattaacctagggatcgttaacctgattccgatcccggccttagacggggggaagctcctcttaaacattgtcgaaggcatcattcgccggccaattcccaaaaaagtggaggggattttgaatttggctggctttgccctcttgatgatcctgatggtccttgtgacctataacgacattcaacgctactttatccattaacaaatttttttgaagaagaaggagaatcgatttatgaagcagtcacagatgctgattccaacccaaaaggaagcaccggcagacgccgaagtcttatcccacaagatgatggtccgggcgggctacatctaccaagtttccgccggggtgtgggcctacttgccgttggcctaccgggtcatccgtaagattgaacaaatcatccgcgaggaaatggacaaggccggggcggtcgaaatgctcctgccgggactcttgccggccgacttatggaaggaatctggccgttacgaggcatacggggacaacctgtttaagttaaaggaccgccgggaacgcgacttcatcctggggccgacccacgaagaaacggtcacctccatcctgcgtgacgccatccactcctacaagaagctgccgctggtcgtttaccaactacaagataagtaccgcgacgaggaccggccgcgttacgggatcttgcggggcaaggaatttgaaatgctcgacggttactccttctctgccgatcaagccggcttagaccaggcttacgatctgcaagctaaggcctaccgcaacatctttgaccggattggccttgattacaaggtgatcttagccgattccgggacgatggggggcaagaactcccaagaattctccgccccggccgcaattggtgaagacgtgattgcctacacggacggcgattacgccgccaacctggaaaaggcaaccaccaagttcaccccgacgaagcaaatcggtgaagaggccgaattgaccaagaaggcgaccccgggcgcccacacggttgacgaagccgccgaaagcctgggcctggaagccagccaaatcttaaagagcatggtcttcttagccaagtttgaaggcgaagagcttaagccggtgatggttctgatgcggggcaacgacgaggttaacgaaaccaaggtcgcttcttacctgggctgcgaagaattgttgatggcctccgaagaagacaccgaaaagtacctaggcgcacacccgggctccttgggaccgatcggggtcaaagaagacgtcaccatcctggctgaccaacacctgcaggggatgattaacatggccctgggtgctaatgacgatggttaccactacatcaacgccaacttcaaccgcgactttaaggtggatcagtttggcgacttccggaccgttcaagaaggtgaaacggcgccggacggtttaccaatcaagttcaccaacgggatcgaaattggtcacatcttcaagctggggacccactactccgaggtcttcggggcgacggtgctggaccaaaatggccgcgacgtgccgatgatcatgggttgctacgggatcggggtttcccgcctgctgtccgccatttccgaacaaaacgccgacgaaaacgggctggtgtggccgcaagccgtggcaccgtttgacatccacgtgattccagttaacgccaagaaggaagaccagatggccatggccgaagaaattacggccaacctagaagaggccggctacgaagtcctcgttgacgaccgcaaggaacgggccggggtcaagtttgccgacgccgacttgatcggggtgccgatccgggtcacggtcggtaagaaggccggcgaagggatcgtggaaatcaagatccgcaagaccggtgaaaccttggaagtgcacaaggaagaattggccaccaacatcgccatcttgcttaagcaaacggctgaataacaagcgaaagtggttcggggatttcaccggccacttttgttttttcttgcattcacccagtaagatgttagaatttagtttgcgaacaaacgtttgaaagagtgcgccctgacggcgtgttagaaagaggagggattttgtggccctaagcaaacaggaacagtttgaaaagttactggagcaaattgactatgccgacccccacttaacgggcggggcgattgaccaagtggtggttcaccagcagtcacgggtgtgggagttgcaccttcacttaagggaggtcttgccgctagccgtcttcacccagctggaacaaaaaacggcggtttcctttcaccaactggccaaggcccaggtccgctttgagatcacgaccgaccaaggggagctggtcccaaacttgattagcgactactggccttacgtggtccggatggtggccggcaattcgccgatggcccaggaaatctgcttaaagacctcgccggagctcgacgacgggcgggtgagcctgctgatggaaaacgaggccgtcgaacagatctttgccaccaagctcctaggcaagatcgaggagggctaccagcaggtgggctttccggcctttcatatccacaccctggtcgaccagagtgcgtcccaagccaagattgaggaattaaaggccaagcaacaaaaggccgacgaggagctggttaaacaggcccgcacccagatcgaacaagccaagcaaaagaaacaggcgaccgccagtgcggcccccgacggcccaattgtgatcggcagaaagctcgggccgaacgatcaggtgacccggatggccacgatcaccgaagaggagagccaggtggtcgtcgaagggtacgtctttgccaaggagatcaaggaactgcgctcggagcgccagatcctgatcctagagattaccgattacacctcctcgttttcggttaagatgttctccgaccggcgggggaccaataagccgctctttgccgccctggaaaaggggatgtgggtcaaggtccgcggttcggtgcaagaagacacctacatgcgcgacctggtgattaacgcccgcgacattaacgaggtctcccaccaggaacgccaggacacggcgccggccgaccaaaagcggattgagttacacctccacaccaccatgtcgacgatggacgccaccaacacgatcggcgaatacgttaagcaggcgattaagtggggccaaccggcgatcgccattaccgatcacgccggcttacagggcttcccggaggcctttagctcctcgtacgacgggaaaaaggacgaaagcaagattaagatgctctacggcgtcgaggccaacgtggttgatgacggggtgccgctggtttataacgaaaaccacctgccgctcaagggccagccctacgtgatcttcgacattgaaacgaccgggctgtcggccatctacgaccggatcatccaagtttcggccgtcaagatgcaagatggcgaggtcttagaccacttcgaccaattcatcgacccgggcttccacctgtcggaacaaacgaccgccctgacctcgatcaccgacgacatggtgcaggggtccaagaccgaagaagaggtcctcaagctctttgacgactttgcggacggctcgctgttagccgggcacaacgtctcctttgatatgggctttatgaacgtggcctacgaacggcacgggatggggcaaatcaagcagccggtcatcgacaccttgccgctggcccgcttcttgcacccggactttcgcggttaccgcttgaacaccctgagcaagcgctttaaggtctccttggagcaccaccacttggcctcttacgactccgaagccaccggccacttgctggcgatctttttaaaggacgccgaggagcgctacggggtgacctacgtcgacgacttgaacaagcatatgactgacaacggggcttaccgccacgcccggccgttccacgtcaccatcttggcggcgacccaggctggcttgaagaacctttacaagctagtttctttgtccaacgtcgagtactttgcccgggtaccccggattccgcgttcggttttgaaccgctaccgggaggggctcttgctcgggaccgcctgtgccgacggggaagtcttcaccgccatgatgcaaaagggttacggcgaggccaaacggttggcagaattttacgattacatcgaggtccagcccaagcctaattatgctccgctgttagagagtggcgtgatcacggatcaggcccacttagaagacatcctaaagaacatggtaaaactcggtagcgccctgaataagccggtcgtggccaccggggacgcccactacattaaccccgaagacgccatttaccgtaagattctgatcaactcccaggggggtgccaaccccttgaaccggaccgagcgccccgacgtgcacttccggaccaccgacgagatgctcgacctcttctccttcctgggcgaggacgtcgccaagcagattgtcgttgataacacccacctggttgccgacatggtcgacgacgggatccgcccggttaaggccggcttgtacccgccgcacatggagggggccgaacaagaaattcaggaccggacctggacgacggccaaggaatggtacggtgacccgctgccgcaactggttaaggaccgggttgaattagaactgaactcgatcgtttccaacgggttctcggtccactacttgatcgcccagcgcctggtggccaagtcaactaaggacggctacctggtcgggtcacgggggtcggtcggctccagtgtggtcgccactttgtctgggatcaccgaggttaacccactaccgccgcactaccgctgcccgaactgtcagtactcgcacttttacaccaagggggaatactcctcgggctttgacttgcccgacaaggactgcccaaagtgtgggaccaagatgattggtgacggccacgacatccccttccaaaccttcttgggctttaaggggaataaggttccggatatcgatttgaacttctcaggggactaccaaccgatcgcccacaactacatgaaggtcttgttcggtgaaaataacgtttaccgggccggcacgatcgggacggtcgccgataagaccgcctacggttacgtcaaggcctacgaacgtgacaaggaagttcagttccgcggcgccgaagaggaccggctggccagcggggcgaccggggtcaagcggacgaccggccagcacccggccgggatcatcatcgtgcccgacgacatggaaatttacgacttcacgccggttcagtacccggccgacgaccaatcggcggcctgggaaacgacccacttcgatttccactcgatccacgacaatattttgaagatggacatcctgggccacgatgacccaaccatgatccgggccctccaggacctgtcggggatcaacccgcagtcgatcccgatggacgaccccggggtgatgagcctcttctccagccccgaagcgctcggggtgaccgaagaacagatcaactccaagaccgggacgctcgggctgcccgaatttgggacccgctttgtgcgggggatgctagaagacacccacccgcaaaactattcccaactcctgcaaatttccgggctctcccacgggaccggggtgtggctcgataacgcccaggaactgattaaaaacggcaccgccacgattgccaacgtgatcgggtgccgggataacatcatgaccgacttgatccactacgggttggattcggaaacctctttccaggtcatggaacacgtccgtaagggaaaggggatccccgaagagtggcaagagaagatgaccgaagtcggcgtgccgcagtggtacctcgactcgtgtttgaagatcaagtacatgttcccgcgggcccacgcggccgcctatgtcttgatggccctgcggattgcctactttaaggtctacttcccgctggtttactacgccgccttcttctcggtgcgggccgatgactttgacgtcgtcgccatgagccacggcaaggaagccgttaagtcagcgatgcaagcaattaccagcaagggcaacgaagccacggccaaggaaaagtcactgctgacgatcctggagctggctaacgaaatgctggagcggggctttaagtttaagatggtcgacatcgaacgctccgacgccaccgactggttaattgatggcgacaccctaattgcgccgttccgggcgatcccgggactggggatcaacgttgccaagcagatcgtggccgcccgggaggaaaagcccttcttgtccaagcaagacctctccgaacgggggaaggtctccaagaccttgatcgagtttatgaccgtcaaccacgtcttagaccaactcccagacgaaaaccagctgtccttgtttgacatgctgtaatgggagtggcaactaacctcctcggcgggtcggctggctaagctaaggcaagggttagcgactacattaatatctgcgaataaaaaagaggcgatggtaaatttgtcatcgtctctttttgtttaagcagtcgtagttacagcgctttctaagacatccgtaatcatgtccagccccttctttagatcgtgttcggtcattaccaaaggtggcaagaggcgaagagtgttgtgcttggccgacagggttaagaggccctttgcttgcagttgggtgatgacgtcattgacgtcgaccaccgggcttaggtgaacgccaatcatcaagccgagacccgagatgctttcgaccgccggcagggtgtctatcttttcatttaggtagttccaaacgctggcggccttttcgtcaaccatcgctaaaaacgacggggttagctgctgtaagacccccttggccgctgccaaggaaagtttgttgccgccaaaggtggtcccttgcgaaccggggccaaaggtggcggcgaacttctttttgccgagcatcgccccgagtggcagaccgttgccgattcccttggcgaccgtgaccacatcgggattcaggttgtaatgctggtaagcgaacttcttgcccgtccgcccgatcccggtttggacttcgtcgataatcaagagggcgccggcttggtggcaggcggtttggaccttggtcaaccagtctggcttaccgttgatgaccccaccttcgccctggacgacttccaagatcacgccggcggtttggtcgtcaattaaggagagggccgaattgctgttgtaatcgccaaaggtgacgtccgggaccagcggggcgtaaccaaccttaatcgcctcgttaccggttaaggacatcgccccgtaagtccgaccgtggaaactgttgtgaaaggtgaccattttggagcgcccggttgtcttacgggcgaacttcattgcggcctcgttagcctcggtgcccgagttgcagaaaaaggctagcttgtcgggaccggcaaggaggccggcgacatcttcggtcaattggctttggtaaaggttagaggtgtgccaaatcttggtggcttgctcgaaaacgttatcggtgatttgctcgttgctgtagccaaagttacaaaccccgatcccgctggtgaagtcaaggtaggtctgaccgtttttatcggtgaggtgccagtcgtggccggcaacgatgtcaatggggtattggttgtaggtattaaaaatattactcatgggctgctccttttaagcgctgacctggtgggccagggcggtccctgactgggtgaggtcattagtgattgaaacgttagcaacgcccctctttagggcgaaaaaagcggcggttagtttcggcatcataccggccgtgatttggtggtgggcgaagagttggttggcaccggtctgatcaaggcgtggcaagaccttgccagcctttaagaccccgggcacgtcggttaagaggacgagcttgctggcgccaagtcgggtggcaatttcggcggcggccgtgtcagcgttaacgtttaagagttgaccgctggctgtttgggccaacggggctaagacgccaatttcgttggtcagaagttggtccagccatgcctgattgaccccggtgatctggccgacctcaccaaagtggggctggtcgaggtaattaccagctagtaagtggtggtcgttagtgtttaggccaaccacggggaggtggtgagtggtcaactggtggcacagggccggttgaaccacccctaataagacggcttgaatcacttctaggcaggctggggtggtaacccggaccccgtcttccttgtggttaggcagcttcatcaggtccagccactggctaatctggggtccgccgccgtggatgatcaagacgtgtttttcctgggcgcgccacttggcaagttggtggtagaactggtcgtctaagagtttactggcgtggccgccaactttgataacgatggtctctgtcataagcccctcctagttgtggtacgaggcgttgatcttgacgtactggtaggtcaggtcacacccccaggcctggccgagcgccttgccgttatggaggtcgactttaacgtttacctggttttcgtggaggtggctggcaaccacctgtgggtcaatcagataggcctgactgtccttgacgacgggttggtcgttgagccaaacgtcaacgtggttggtgtccaagtgggccttggtttgtccaattgcccccatcaggcgcccccagttcgggtcctcgccgaagatggcggccttgaccaggttagagccgacaatggccttagccaccatttgggcttcgtcgtggttgtaggcgtgcaagacgtcggcttcgactaacttggtcgccccttcgccatccttagcaatcgacttggctaagaaactcagcacctggtggaaggcggcggcaaagagggcgtagccagccggatctgccgttactggtgaggtttgggccatcccgttggccaagaccagtaccatgtcgttggtggaggtgtcgccgtcaaccgtgatctggttgaaggtttcgtcaacctgctggtttaacagctgctgtagggccaccccgtcaatcttagcgtcggtggtcacaaagcctagcatggtcgccatcttggggtggatcattcccgaccccttggcaaagccggtcacggtgactggttcgttattgaactcaaactggacgctgatcgacttggggtgcttgtcggtggtcaaaaccgcctcggtcacggcggcggacttggttaggctgagttggctaatcccgtttgtgatcttatccattggtagtggttcgccgatgatcccagttgaggccacgccgaccaactgatcggttaagcccagcttcttggctgctaggtgttgcattgttttggcgttaaccatgccctggggcccggtgcaagaattagcgttagcgctgttcataaccaccgtttggagttggtgggccaagttgacggtttgcttcgttagcttggtcggggcggcttggaactggttggtggtgtagaccccggcggcagcggccggcaccttggaatatagccagcccaggtcctttttttcttccttcagaccagcgtgtatcccgtcggcataaaaacccttgggccaagtgaaagtggttaaggtgttaatttcgtgtttagtcatggtaacaattcctttctcttttgaagctacggcaggaggggagccgtcggtaaaccagcggtcggtgcgaagttaaaacgttggttgaagttttggattgcctggccaccggcgcccttaatcaggttgtcaattacgctggccaccatgatcgtgttggcgcgctcgttgaacaagacccccaggtcgcagtagttggtaccgaccacttgcttaatggtgggtaagttttcaccggtataacggacaaaggggtcggtcgcgtaggtttgtttaaaggcagccaccacctgatccttgttaacgcccggtttgggtttagcgtaaatggtcgctaggattccgcgggtaatcggtaagagggtggtgctgaattggatagcatcaacggccggatcccaagcttgcagttgttgaacaatttcggggatgtgcttgtggtgattgacgttatacagctgggcgttttcattaacctgagtaaagtgagtgcttgacgtcggctttttgccggcgccagaggttcccgacttggcgtcgaccacaatggtatcaaggtcgatcagctggtcgatgatgagtggtgccaagcccaagagggtcgccgttgcgtaacaacctgggttggcaatcaaattctcgtcagtagcgtcacagaagtcggtcagaccgtagtgggcgactttgaggtcggcggtggcggccggggattggtggtaccacttctcataggtggccccgtttttcagtcggtagtcgccagagaggtcgattactgggaagtgggcggttaaatatggtcgggcagcggtcttcgtgacaccggctggggtggcaaaaaagaccgccccgtcgttagctaagattttttggctgtcgtaggggtacaccggttggtcatcaaataaattagggaccaactgattcaagggcgtcgggccagataagtggcgggcgtagagatcaacttggtcgatccccgggtgggttttaagcatttggtagaggaccatcccgccgtagccggtgatcccgattagggcaactttcatcttcttcatctcttttatgcaagttttataaattttttcgattgctaacagcctacaacgtggtgaccggattagcaagatcttttttatttttatccagaaaatacggataaaatgcgttaaatgttcataaataaccaataaattccgctatttcaaaattactccttgcgtggcgagtgaaagggcgttatgatcgtcactgaatatttatacacataacacgaataaaggagccgttaaaatgaataaatacctcatcttagaggacgggaccacctacccggggaccgcctttggggacctgggggcgcaagtggccggagagttggtgtttaacaccgccatgactggctaccaagcatccctgaccgatccatcctacttaaaccaactactaacctttactaaccccctaatcggtacttacggtatttggcccggccaaagtcaaagcaagcaagtgaccgctggtgccgtgatcgtccgtcagctcgaaaacgaaccgggaccgactggccagaccttggatgcttggttagtcgaccatcacgtgccgggaattgagggtgttgacacccgggcgattgccatgcacttacgcgaagacggcaccgttaaggccctgctagttaatcagctggtgaccccaactgagtttacgaacttatatagccggttggtcggccagcagaaacttcccgctcgaaacgctggtgctacggacccaaccgccaacctgaccgttgccctgatcgatcttggggtgaagcaggggattattgataatttagtggactgtgggtgtcgagtcgtcgtcttaccaccatcggcggcggtcgccgaggtccatgagctcaacccggccggggtcttgatttcaaacggtcccggcgatccgctggactaccaggcggtcttacccctaattcgaggtttggaacacgactacccgctggcgggaatctgtttgggacaccaattgttagccctagctaatggtgcaaccacttatcggctgccttttggccaccggggggctaatcacccggtgacgctgttggcctcacagcaaacgatcatgaccagtcaaaaccatggctatgccgttgatcccaccagcctcaagaagaccggcttaaaggtaactgccgttgagggcaacgaccacacggtagaggggctaaccttggttggctacccggtcatttcggtccagtttcacccagaggccgggccgggcccaaacgacgcccggaactttttcagtcactttaaacagttaatggaaacgggggtggcggtcaatgcctaagagaacggatttacacaagatcttagtgatcgggtcgggaccaattgtgatcggtcaagccgctgagtttgattacgctggcagccaggcctgcatcagccttaaggaagagggttatcaggtggtcttggtcaattccaatccagctacgatcatgacggacgatcaaattgctgaccaagtctacttggagccactgacggtaccgtcattaaccgagattattgaactggagcaccccgacgccctcttgccaaccctgggcgggcaaaccggtctgaacctggccatcgagctcgaccaagccggcgtcttaaataagttcggcgtcactcttttaggcaccgatttacaaacgatccaggaggccgaagaccgagagcaatttaagcagttaatggaggagattgggcaaccggtaccggcgagcctaaccgttcacactgtcgaggcagcttgtcagtttgccgaagaagcgggctacccagtaatcgttcgaccggccttcactcttgggggaaccggaggcgggatcgccaacgaccaggaagagcttgagctgattgctaaacgggggctagctcagtcgccggtcacggaatgcctgattgagcaaagtatcgccggcttaaaggaaattgagtttgaagtaatgcgcgatgccaacggggacgagataagtgtttgttgcatggaaaattttgacccggtcggtattcacaccggtgattcaatcgtagtggcgcccaaccaaaccctgccggatgttcagtaccaacggcttcggtcagcagccctagcgatcgtggccgccctaaagattgaagggggctgcaacgttcaactggcccagtcaccgattagtgatgattattacgtgattgaggttaacccgcgggttagccgttcgtcggccctcgcctccaaagcgactggctacccaatcgctaagattgccgctaagatcgccgttggccttaacttgagtgaaatcaccaatccggttacccagaccacaatcgctgccttcgagccagccctcgactacgtagttgttaagttgccgcgcttcccctttgacaaattcggtggaaccgatcgccacttagggactcaaatgaaggcaaccggggaggtgatgggcatcggtctaacctttgaagaggcgctcttaaaggcgattgactcgctggaaattgaccctggggttcaggcgagcctcctgccggctaacgatgatcagctaagcgaccaggaattggtggcagctcttaaatcaccaactgacctgcgactgtttgagctcttcgtcgcccttaaacggggctattcaaccgctgacttagcggaatggaccaagatcagccccttcttcttgcacaagctggcccacatttggcaactaaagcgggaattagtatcgcaggggggagaggtagtggttagtgccaagcggtttggctttaccaacgccatgctcgccagtgcgctccgatgttcgttgtcgaccgttgagcagctagttaaaagtgcggggttagccccggtttacaagaccgttgatacctgtgccggggagtttgctagtgcgaccccgtactattacagcagttatttcccgggcaataacgagagtcagccactgggcaatagtgtgttagtgcttggttctggtccaattcggattggtcagggggtcgaatttgattacacgaccgtccactgcgttcaagcgattcaagaggccggctaccgtgcgatcattatcaataacaatcccgaaacggtttcgaccgatttttcaatttccgacaaactctactttgaaccgctgacgattgagcacgtcatgaacgtggtcaacctagagcagccacgcggggtgatcgttcagtttgggggtcaaacggccattaacctgaccaaggaactggttaaacggggggttaaaattctgggcacctcactccaggggattgaacagaccgaggaccgccaccagtttgaggaattactcaaggacgctggaatcgcccaaccaaagggggccacggcgctcaatttagccgaggccaaggtgattgcaccggtggttggctatccggtaatggtgcggccaagcttcgtgctgggtggtcgggcaatggcggtcgtggaaaacgaaaccgaattggtaacctacgtcaacaaggccctgaaggcggcccccaaccaaccggttctgattgatcactacgtagctgggcttgagtgcgaagtcgacatcttaagcgacggtcacgacgttttgatccccgggatcatggagcatttggaggggtccgggattcactcgggtgattcgatggccctgtacccaccagttcgcctgacgtcagcccagcaaaaagaaattgttcaaactgcgattgcaattggtcaacgggtccactgtctgggaatgatgaacattcaattcatcgttgccgaccgggtctatgtgattgaagtcaacccgcgggccagccggacggtaccgtttatgagtaaggtaactgggtatcacttagccaagctagctacccggctaatcctgggtaaaaccttggtcgacttaggtttaccaagtggtttagcaaccccaagtaaccacttcgccgtcaaagcgccggtcttttcctttgctaagttggccggacttacttgccggttggcgccggaaatgaagtcaactggggaaacaattggaattggtgaaagcccggccgtagctctggccaaggcgcttgctaatagttatggcttagtaacgccggtgaagggtcaaatcgtcttacttgacccagttgccgctactgactctaaattacgggctcaacttgaacaagcggggctccgggtcgaggtctgggcaagccagcaattgccaacgctggaacaccaacgggtctgggcagtggttaatgatgacgaatcgcaaaccacgatagcaccattgaactactacgccctgagtaacggggtgcccctctttacggcggccaccagccttagtgaaatcatgtcgttaagcagggtgggggcgccgctggttaatttataaaaaggactaaaatttagccctgaaaagagatcgctggtcgccaagcttgtcagggcgggcaaagaatggtatattagtatttgaaataactcgttgagggggtgagcagaaatgctcgctctttttattgtaatgaaacgggaggtgacgagatgagtaataagactgtagtcgagaccgtaacggcgctggtggaaccaatcttagctgaacacaactttgaactgtacgaagttgaattcgtccaggaagccaagagctggtatttgcgggtctacatcgataaggaaggcggcatcacgctggaagattgtgcccttgtcagcgaccagttgagcgaacaactggacagcgccgatccagacccgatcccccaggcctacttcttggaagtttcttcgccaggggctgaacggccgctgaaaaaagaagtggactaccaacgggcccttgaccaatacgtgaacgtttctttgtaccaacaaattgacggccacaaggtgtttgaagggtatcttcgccaattgagcccggatgagttaaccattgagtacatggataaaacccgccaaaagcaggttgtaatcccgcgggacaaggttgccaaggcccgcttagcgattaagttttaagagttgaaggagtcgaaaaatgagcaagaaggaagaccgggtagaactactcgacgcgatggacatcctggaaaaggaaaagggaatcaaaaaagaggtcatcattgaggccttaaaggacgccctggccaacgcctaccaaaagaattacgaagacaacgcggccaacgtggaagtcgaaatcagtgaccggaccggtgaatttaaggtctacgccgctaagacggtggttgaagaagtcactaacgacgtggaagaaatttctttggccgacgcattgcgggttaaccgcggttacgaactgggtgatatcttcaaagaagaagtgacgccgcgcaacttcggtcgtctggctgcccaaaccgccaagagcgtggtgttgcaaaagctacgggacgaagaacgaaacatcatctttgacaagtacaacaagttaaaggatgatttagtcgaaggggaagtctcacgagaagacgaacgctacatctacgtcaacctcggtgacggtgtggaagcggccatgaacaagcatgaccaaatgccaaacgagcactaccgggtgcacgaccggatccaagtttacgtgacccgggtcaacgacaagagcggcgcccgcgggccgttggtcttcgtttcccggaccagtccggacctgctcaagcggctctttgaaaaggaagtgccggaaattcaacaggggatcgtggaagttaaggggatcgtgcgtgaagccggtgaccgggccaaggtggccgtcttctcccgcgacgaaaacgttgacccagtcgggacttgcgtgggaccacgcgggacccgggttcaggcgatcgtcaaccaactgggcggcgaaaacatcgacatcgttaagtacgaagaggcgccggaagaatttatccgcaacgccctgaacccggccgaagtcgaaggggtgctcttcgatgaaaacaacggggaagtcgatgaaccggctagcgtcgacgaaaacggtcgcaaacacgaggaacggatccaccgtggttgcaccgtgatcgtaccggacgaccaactgtcactggcgatcggtaagcgggggcaaaacgttcgcttagccgcacagctgaccggctacaagatcgacatcaagtcgtcatcccaagcggcggccctggaagaagcgcaaccagaaccagcagcagaagttgtagagcagccaacccaagccccagagcttgaccaagccgctgacagcttcgcagacgaagactagacttaatccttatcaagaaagcaacggggtgaaaaaatggttaaaaagaaaaaaataccgatgcgtaaggatatcgtgaccggagaaatggtgcccaagcgagaattaatccgggtcgtcaagaacaaggaaaacgaagtatcgcttgacccaaccggcaaaaagccggggcggggtgcctacgttgccgtgagcgtagcggttgcccaaaaggctaagaaggaacggacctttgacaaggcctttggcgtaacgctcactgacgaattttacgatgagttaattcaatacgctgatcaccaacaagcacgccgagagctgttcggtaagaatgattaatcagcgtcagcaaattttaaacctcctcgggcttgcccggcgcgcgggacagctagtgactggtgaagggatggtcttaaccgcccttcaaaaagaccaggtgcggattgtcttgctcgcaagtgacgccggccaggcaaccattaaaaaggtgaccgataagtgtcaaacccaccaagtgcgggtggttaacgattttacccggctagaaattagccaggcaatcggccaggcgcgcacgatcgtgggaattaccggggcagggtttgcaaagaaaatccatcaattaacaaccaaactaaatgagggagagtgagcgtatggccaaagaaagaatttacgaattagctaaagagctcaaaatgccaagcaaggacctggttaacttagccaaaaaggaggggatggacgttaagacccacatgtcttccgtcacttccgacgaagccaacaagctgcgttcaatggccaagggggcgggtaagccagctgctgttaagccggcaccaaaggtccaagaacaccagtcggccccggcgaagaaggaagccagccgtccggccaaccaaggcagccaaaacaaccagaaccgtaacaaccgggggaaccggaacaacaacggcaacaataaccgccacaacagcaataacggttccgctaatgctaacggtaacggcggcaaccaaaagcggaaccaaaagcggaaccaaaacaacaacaacaacaaccagggtggccaagccgctaaccggaacaataacaacggtcaaggtcagggtgcacactggtttaaaaagggtaagaagaacaacaagaagaagaaccgtaacaagggtaaccaacgcctgcgcgacacggctcctaaggccccaacccaacgcaaggatcggccgctgccggacgtattggaatacacgaacggcatgaacgcccaggacctcgggaagatcttgcaccggtcaccagccgaaatcatcaagaagctcttcatgttaggggtgatggtgaaccaaaaccaatccctggatgcggacacgattgaaattttggcggccgactacgggatcggagccaaggaaaaggtccaagtcgacgtggccgacttagaccacttctttgacgaacggatcaacaacgacgccaacctcgccgaccggccaccggttgtgacggtcatggggcacgttgaccacgggaagacgaccttgctagacaagattcgtcactcccacgtgaccgaaggcgaagccggcgggatcacccaagccattggggcctaccaagttaagtacaacgacaagttgatcaccttcttggacaccccagggcacgccgcctttaccgaaatgcgggcgcgtggggccaacatcaccgacatcaccgttctagtggtggccgccgatgacggggtgatgccacaaacgatcgaagccattaaccacgccaaggcagccggcacgccgatcatcgtcgtcgtgaacaagatcgacaagccgggcgctaacccggaccacgtcacggaacaactgaccgaatacggcctgatcccagaagactggggtggggacacgatttacgtcaaggtttccgccaagttcggcaagaacatcgacgaattgctcgacatgatcttgctgcaagccgaagtgatggaattaaaggcgaacccagaccaaaacgccgctggggcagtggtggaagcccgcctcgaccaggggaaggggtccgtagccaccctcttggttcaacaagggaccctgcacgtaggggacccaatcgtggtcggcgacacctttggtcgggtccggacgatgaccaacgaaaacggccggcggatcaaggacgccaccccatcgacgccagtcgaaattaccgggctcaacggggtgccggaagccggggaccactttgttgtctttgacgacgaaaagacggcccgggccgccggggaagaacgggctaagcgggccgaagacgaaaagcggcgccgcactagtcacgtgaccctggacaacctctttgacacgatgaagaagggtgaaatgaagtccctgccgatcatcatcaaggccgacgttcaagggtccgttgaggctctcgcccaaagcctgcaaaagatccaggttgacggcgtgcgggtcgacatcatccacaaggccgttggggcgatctctgaatcagacgttaccctggccgaagcttccaacgccatcatcatcggctttaacgttcgcccaactccgctggcgaagtccgaagccgaaactaacaacatcgacatccgcttacaccgggtgatctacaacgcgatcgaagaagttgaagacgccatgaaggggatgctggaaccagtttacgaagaagaagtgctgggtcaagttgaagtgcggcaactttacaaggcgtccaagatcgggacgattgccggggggatggttgtctccggtaagatcacccgcgacgccaaggtccgcctgatccgtgacggcgtggtcatttacgaaggcgaattgggctcactcaagcgcttcaaggacgacgctaaggaagttaagatgggctttgaatgtgggttgacgatcaagaacttcaacgacgtcaaggaaaacgacgtcatcgaagcttaccacatgaaagaagttccggttaagtaaaggaggagcgccatgccgaataagcaattccgggtggaacggctcgcgcaacagattcagcgcgaagtcgacgacatcctcttaaagcgggtccgcgatccccgggtcaacggggtaacggtgaccggcgttgacgtaacgggtgacctgcagcaagcgacgatctactacacgatcctgtcaaagctggcttcggacgccgagaaaacccaaaccgggttggataaggcgaccgggctggtgcgcagcgagctggggagccgcctgaatattttcaaggcaccggaaattaagtttgtccgcgacccatcgattgaatacgggagtcgcattgacgagctgctgaacgagcttcacaaaaataacgagctctaacagtagttgggccctagcgttcgtttagtggacgttggggccttttttatagagcagaaaggaagaccaatggacggaatcattccactttataaggagcgggggatgacctcgtttgattgcatcgcccgcttgcggcggattttacacaccaagaaggtcggccactcggggaccctggatcccaacgtggacggggtcttaccaattgcgatcggcaacgccaccaaggccgtggaatacctgatggcctcgggtaaggagtacgccggcgaattgacgattgggctagcgacgaccaccgaagacctcgatggggaagtggtcgaccaaaagccggtgccggcgcccatcgctcgagaaatgattgcggaaaaaatggccgaaatgaccggggaaatcacccaggtgccgccgatgtattcggccgtgaaggtcaaggggaagcgcttatacgagtacgcccgggctggtgaaaccgtggaacgccctaagcgccaagtgacgatcgaccagttcaccctgctagccaccagttacgaccaggaacggcaagtccagcgggtccgctttaaggtagcctgctccaaggggacgtatgtgcggaccctggccgtcgacctggccgccaagttgggctacccgggggtgatgtcgtctttgacccggttaaagtcgggtggcttcaccttggatcagaccctgagccttgatgacatccaagacatggtcacggcgagcgggatggtcaacttgtacccgcttgattacgccgtcaaggacctaccccacctggcactcaacgccgagcagtggcaagccgttcaaaacggtggctggctcaagcaaagcgaggtaaccccccaagagccgcgggtggtggtcacctaccaaggggacaccaaggccgtttataagcacgttgagcgccactaccaacccgaaaagatgtttaagaatagttagagggaagacaatggaagtaataaaggtacaccatccactattagagcaacaggtaccggacggtccggtagtggtcgcaatgggcttttttgacggggttcaccgcggccaccaagcggtgatcgcccgggccaaagaagaggcggtccgccgccaggtccccctagccgttttgacctacgaaaagctaccggggatcgtctaccagcgctacgaagagggggtccattacctgaccaccattgaccggaagctggccctgctggaacagctgggcgccgatctggtttacttggttgacttcacggccaaactcggcagcctgagtcccgaagagttcgtcagcgattacctagtcaggatgcacgcggtggcggtggtggccggttttgaccacacctatggtaaaaaggacgtcgccacgatggaccgcttggcggggtacgcggccggccgttttgacgtggtgacggttaaaaaacaggaaaccaggggcgcaaagattggctccagccggatccgcgacctgattgaccagggccgggtggaagacgctaaccagctcctgggctaccggtaccaaaccagcggaatcgtggttcacggtctggcccggggccggacgatcggctttccgaccgccaacgtcgcctggaacccgctcgaacggatcccggccgtgggtgtgtacacggtcaacttcttggttgacggccactggtacggcgggatggcctcggtgggctacaacgtcacctttgggcaaaataagcacaagacgatcgaagtttacctctttgatttcaagggtaacatttacggcgagcacgtcaccgtcagttggatacaacggctgcgcggcgaaattaagtttgacggcgttgatggtttaattgaccagctccacgccgaccaaatcaactcgctagcgatcttaaggaaccccccgaccttaccggcggggccgttaaattagtcagcgttataaagattaaagaggccggggaaggtgggctccccggcctttttttgttcccggctaagtggtatatttaagaaattatcgttacttaggagcgggagaagaaaattgaaggatcaacgaattgcacggtcactagtcattatggtctttgggaccttctttgggttattgtgttccaccctgatgaatacggggttgccccagttaatgcgggtctttagcgtgagtgaggggacggtgcagtggatcatcaacgcctacatgctaacgaacgccatgatgatcccgttatcggcctacctgattcggcgctggtcctttcgcaccctttttatcatcgccacggtggtctttttagtcggcacggtggggggagcggtggcgcccaccttttggacggtcgtgattgcccgggtggttcaagcggccggggcggggatcatgatgcccctagtcaacgtcttggcgatccgctacgccgaacccaagaaaaaggggacgatcatggggatcattggactggcctttaacttctcgccgatcattggtccgaccgtgtcggggctaatcctagacgacctatcctggcgctggctctttttggtaatcgtgcccttctccgtactcaccttagtggcggcgatgatccagttgccccggatcccccacaacgaaaacccccacttcgacacccgcgggatggcgattgtctcaatcggcctgtgggcattactgatggggctatccaacgtttcgaccagcccgttttggacctggcaggtgctggggctcttagttgtcggggcggtcgcgttagtcatcttttacttcagccaacgcggggttaaggcgcccttgattaacttctcggtgatggcctatgatcaattcgtggtggcaaccttgatcaacatgttgatcgtggcgaccatgtttggcaacaccatcttattgccgctcctagtgcaaaacgttcaacaaaaaagcgccctggtgtcaggactagtgatcctgccgggggcgctagtgacggggttcttgtcgcggttaagcgggcggttgtacgaccgcttgtcggtgcggcggctggtcttgttcggactggtggtggacggagcggggaccctgtttcaagctacgattggcgccgctagtgggccggtggtcttagcgctctttcaggcggtgcgccagctggggttggtttcgatgctgatccccctgcaaacccacgccctggggatcttaccctttgacctggtgccagacggggtagcgacttttaacaccatccgtcaggtagcggcctcgctgggaacggcggtgctcgtttctgtcgtcggcttaatggggcagtggggccacctggggaccctctttgggatccaggccggttttgccacctgctttatcttcttggtggccgccatgatgatcgccgggcggctcaaaagccagtttaaactgggccggccgacggtgagtgccgggtaaaggaggatggcaaatgacttcccgggcaggtcgtatttaggcactaggtctgccgtacaatagtcttaaaagttgtcactttaagaaataaaaagtgatgacttttgaggctatttttatgaaaatcacctattcaacgactactaagcttcgcttattaagtcaatttcaaaatcttgatgtcactccttaggtaaatctcaatcgcgcgttttcagttttatgaaagcgctaactccatttctcggtttttataatagcttgcttgctgccatatgtaaaccggtttgtatatatttttcaaaaaaaatcccccgcccgcactgcgaacgaggaatagcgggggctaagcagtcgtcccctcaactaatttaaccggcagggtccggtactgaacggcgggttccccggcgattttttccttcagcaattccacggccgcctcggccatttcctgaatcggctgttggatggtcgtcaactctggcaagagcaagcgggtcatatcggcgccgtcaaaaccaatgatcttaatgtcttctgggcaccgccgccccgcttcggtcgctgccgtaagggccaaacgggcgttggtgtcgttatcggcaaagatcccatcgacttcggggtgttcctcaaagatcttgcggatccggaccagtttttggtcctctggttcatcgaagggcacctggtagacaatcgccggccggtcgttttggctcattaagtcgcggtaggcgctctcccgggcctggtttggcgaggcaaagccccccgggtagttggtgtgaatgatatgttgacagccgtcgtcgagcaggcgttgggtggctagccgcccgccctcgtagttatccaccgacaccaccggcacctgattggaaaccacccgttcaatcgaaacgattggcaggctggttttgtggtaggccgggatttccgggttgtgggccccgacgatgaggccatcgagttggcggtccaagaggagttgcaagtagttctcttcctttttggcgttgttttcgctgtttcccattactgcccggtagccctcgttgtagaggcacttttcaagggccgcctccaactgggcaaagtaggggttattgatggtcgggaaaatcagccccaccagcatcgtctcttgtttgtagagttggcgggcaattgcgttggggcggtagttaaggtcctccatggcctggtgaaccttatcaatcgtcttttggcttaaatacccgcggtggttcaacacccgcgaggccgtggccttagaaacccccgccaagcgcgccacgtcgtctaacttaatctttttttccatcttctttctcgtccttccaccagagtttaattagggcttgggtgcccaagtcgccgtggcctgagtccaccagctgttcgtagagttgttttgcgaccttagttgccggtaggtcaatccccatggcgtccgcctcttctagggcgatgcgcaggtcctttaggaagtgcttagcaaagaagccgggcgtgtaatcgtcctttaggatccggggggcgtaattggtgaggctccaattagccgccgccccaccaccgaccgtggcgaccacgtcttgtaaattgaggcccgccgccttggcgtaaaccagggtttccaccagtccggtcatcgtgccggccaccatgatttggttggccatcttggcgtgttgccccgccccggcggtcccaaagtagtggatatccttgcccagttgcaaaaagaccggggtcatggtttggtaggcttcttggtcgccaccaaccatcacggtcagggtcccttccttggcccccttatcgccgccagaaactggggcatctaggattcccactccggccggggtcttttgcttaagttctcgctccaaactcggcttactggtggtcatgtccaccacgatttgacccggctggacaacgctaaagatccctttaggtcccaggtaggtttcttcaacgtccgccggaaagcccaccatcaccatcacggcctcgctatttaaggtggcctccgccgggctagccgcccaactagcccccgccgcgagtacctcctcggcgtgggctttggtccggttgtaaaccgttacccggttaccagccttcaacaaatttttgacaattccggtgcccatgaccccagttccgataaatccgattttcattttcttcgccttcctttgttaacaatagtaaccggtttcttattgattggaaagccattttgatgataaataaaaagcgcaccccgctttagagtgcgccttaaaagtttgtgcagtaattagtttttcaaggcttcttctacttgggcccgggttgggatcgatggcattgcccccatcccttgaaccgtcaagctggaggcccgttgagcgtaggtaatggcgtccgccaggttttccattgacggggtcagttgggaaaccagaccgccaatgaaggtgtcgccggccgcggtcgtatctaccgccttaaccttaaaggccggcacaatcccgctcttgccgttgtggttgaagtacgccccccggctacccagggttaccaaggtagtagctaccccttggccccggaagtagtccgccgtcttggccaggtcagcctcatcgttgatttcaattccggttaacagggcgctttcggtttcgttaggggcgatcacgtcggtcaccgccagcaagcccggtagaatttccttggctggggccgggtttaagattgtcgtcaccccgtgttccttggccagcttaaaggccgccagggttacttcttgcggagtttcgaactgactaaccaaaaagtcgacttggtcccacaggtcgtcggtccggtctaacacggcggtggtcatcgcctggttggcccccccgtaaaccatgatgtcgttttggccgtttgcgtctagggtcaccagggccgtcccggtcccgtggcgaacgtcattgccaacaaactgggtgtcaacgccgtcttcttgcagggcttcacgcatgaaacgcccttcgttatcggcgcccaccatcccgatgaaggtcgtctgcgccccggaacgagcagcggccacggcttggttagcccccttgccccccggtgccgagctcttgtcggtagccgacagcgtctcccctggttccgggaaccgagcgacgtggtaggtggtgtctacgttaatactccctaaaacggcgatgcggttagtcatgattttcctcctctggtgcgttcgttttcggtaaatcgttttacgttacttgatcgtttactagtataccggacttgtaaaccggttacaagtaaaagttgagtgctaaacaacctcctcggcaggtcgtatggctaagctaggacgaacggttggtgcgaaacgcaccgttcttcgtccgtacttagacactagacctgcggttggttagcacgatatctgtgtaaacttagggaatcaaaaaaaggtgaccaagaaatcactgattcctgtcaccactttttctatccctcactaagtttccgttccaagtagtgggccaagcggtcctttgggtacagtcccgtcaccttttccttggccttcccgtcccggaataagaccaggctcggaatgctcatcaccttgaattgggtggccgtttcctgatcctcgtcgatattaaatttaacaaacttaatccggtcgccgtattcggcttctagttgatccatgaccggtgccatcatcttgcagggcccacaccatggagcccagaagtcgaccacggttaccggaccctcaactagttgcttaaagttatctttgtgtgccacttgtgccatctttttccccccctactgacttgcttgaagaagctgggtgcttcccccggcgaaggaagtgtaccaccccggtcaaggcaaagaccagtaaaatgaaaatcccgaagagccccgatggaatttcgatgtcgattgccgggatcgtcagaaacagtttaacggcgataacggcaattaatacgtaggccatgggctccagttccggaactttccgcattaagcgcatgatgaattcggcgatcccccgcatacacaggattccaatcaggcccccgatcaagacgatcaccggattgttggagacggcaagggcggctaagaccgaatcgatggaaaagacgatgtcggtaaactcaatctgcgccaccacggcccaaaagcgcttgcgtccggttagcttccccagccgggagctcttcttatccttgtgtagggaatgcttaccaaagaacttaacgtgaaagaagcggtaagccatatacattaggtaggccgccccgagggccttgatttcccagaagtgaatcaagtaggtcccgatcccaatcaccaggaaacggaacagatacgaaccccagattccgtagaaaagggattcctcttgttcccttagggttggcaagacccgggtttgggcggctaagacgacggcgttatcgacggagagcaaacactccatcattaccaaggacaggatgattaaccagtcctgtccggaggttacgaccgccgcccagttgtgtaagtcaaagaatggtccgtagagattctcaataagtgacaattaattatgcacactcccttgtattgttgatttgtgacttgtctacccctattctatcaaaactgggggaaatcgtcagggattttggccacaatccgttcccgttttaaagaaaaggggagcaccaattcttgcgccaccccgtgcaagtacatccggggggccgccaccgtaccgtataacggatcgcccacaatcgggcagccagccgccgccaagtgcacccgtagctggtgggtccgcccggtctcgaggttcaacaccactagcgcccggtcgtcattgacggccaaggtccggtaatgggtccgggcgggctgggcgtttttgccgaagaccttgcgcttacgaacgtcggtcgggtcctgtcctaagggaaggtcccaaatcccgcgggccgggttcggcaccccggccaccagggccaagtagtcacggtgaatttcgccggtactaatcaaccggtctaaaatcggcaccaccaccggatttttggccacgatcatcgccccgctggtttcttggtccaagcggtgaaccatgtaggcggcgtcgttagtcccctctaaataggctgccacccggttcatcagggtgccgacttcgcccgcttggttggggtggcttttaattccggccggcttgtcgaccaccaagaggtcccggttttcgtacaggacggtcaacggtcccggatcgggaaggtacgatgaatcgggcgtgcgaaactcgtcgccggaaaaattaagcgtgatcacgtcgccagccgcaaccgtcttcgacaccggacggtaggagccgttgactaggacctgacggcgactgcgcaggtagtggaccaaacgcttgggcaacagccactggcgctgcaaaaggtgccgtaagggcgttgcctcttgatccaccggcaggcgttcttctatttgccagcgatattccatcatcattccccctttgtgactattgtaacctagaccaagggattggcaaactggtgtataatggggaaagctaagaaagaggggtgtgcaatgtgttaagttccgtcaagtttaatgaccacagttactgggtgtcggtctttgagcccctcccccacgaacgcgatgagctctttgaaaaatacgaagtgacgagtgatctgcttgactacgccatcgacccctacgaaaaggcccggattgaaatcgatcgtgacgccgggatcaccctgctcatctttgacgtctacatccccaaccacgaggaatcagccccccaaaccgccccggtcgggatcatgctgaccgaaaacaacgtcttgacctttaccaacgcccacactaacttcgttaacggtttaattgccgaacaactcaagcgcctccaggctcacggcgacatcgacacccgctacgactttatcttgccgatcctctaccggctgtcaacggcctactttcccccgattcggcgggccgaccagcaacgccaaaagatccaaaataacttgcggcgccggaccgaacgctcggcgatcaccgagtttatggaactagaaaccgggttggtctacatcttgacctccctgcagggcaacgtttctttgctccaggaattcaagcgccgcttcggttaccggatgagcgtcgaccagcaatccgacctggacgacgttatcatcgaagcccagcaggggttggaaatggcccagatgacctcggacgtgaccggccgggtctccgacgcctacagcaaggtgctggattccaacctgaaccaaacgatgaagtttttgaccgtctactcaattatcttatcgatcccgccgatcgtctctggtttttacggggaaaacgtcaagtccctcccctttgccaacaacgactttgcttggcaaatcaccatcatcattaccctgatcatggtcgccatttcaatttggctgatctttaacaaacggtggtggcgttaattttcggaaaataacgatgattaagtttccataagattgtatcgttcgcttttaagtggtaagatactggtatcaaatttagaaaacgtaagtgcctatataatcgccgtaatatggtcggcaagtctctaccttcagccgcaaactgaagactataagcaaaagtgagtgggcttttgtgggtccacttttttatttaggtacctgcggggaggaatcttttgaaactttcaccgtcaatttccgctgaacaacgcctggaggggcaagcaaccaccttctggcgccaccttatcctaggtttccaacacctgttagccatgtactccggtgacgtcttagtgccgttgttgatcgggaactacctgcactttaacgccgcccagatgacctacctggtttccatcgacatcttcatgtgcgggattgctaccttactccagttaaaacggaccgctttaactgggatcgccctaccggtggtcctgggctgcgccgtccaggccgtcgcccccttggaatcaatcggcggcaagctcgggatcggctacatgtacggcgccattatttgctcggggttgtttatcttcttgattgccggcgtctttgccaagctcaagaagctcttcccaccggtggtgaccgggtccttgatcacgatcatcggtttcaccctggtaccggtcggttttcaaaacctcggtggtggggatgccacggcgaagagctttggtgcccctagcaacctcttaatcgggatcgttacgatcatcatcatcgtcatgatcaaccgctttgccaagggctttttaaagtcgatcgctattctgctggggatcttactggggtccttatttgccggcgtcttggggatggtttctttaagccccgtcgccagcgccgcttggttccacgccccacagttcttctacttcgccaccccacaatttaactccagcgccatcgttaccatgatgctcgtcgccttaaccacgatgatcgaatcaactggggtctactttgccttaagtgacgccaccgacaccaagatcaccagcaaggatatggcccgtggataccgggccgaagggattgccgccatgctggggggctgtttaacaccttcccgtactcgactttctcgcaaaacgtcggggtgctcaagatgtccggggtcaaaaccaagaagccggtttactacgccgccttccttttgatcttgctgggcttattgccaaaggccggcgcccttgccaccatcattcccacgcccgttttagggggcgcgatgatcgtcatgttcgggatggtcggggtccaggggatccaaatcctgcacaaggtcgactttgctaagggttccaacctcttggtggcctccctgtccgtggggttaggcctcggggtcaccgtctacccgcaaatctttcaacaactgcccaccgaagcccaaatcatcttgggtaacggggtggttgtcggttcggcctgcgccgttatcttaaacctaattttgaactaccaagacttcttcaaaaaggaagccaagtaaaaaaaggacccgcgtcggcgggtccttttttacttagccagcaattccttgatgctagcaactaacgtcggcagcgggtgaccgaggacggtggccaagtcatcgcttgtcacatccaagtcccccgcctcgtgcggttcttcaaaggaggcgatcatggttgccatcgcctcgtccataccactctttaccaaagcggcttcataagcttcccggcttagtttagccacttctacctccttgcccagggcttcttttaaggcgtccccgagttcttcgtagctgattggttgaccgccaaattcgtaaacttcctttggctggtcactcaccagcaccttagcggcggcggtggcgtaaagggcctccggtgcccaagctgccttaccagtggtccagtaaatggccgcttgcccctccttgccagccgtcaggaagctggcgtcgttttccaggtaccagttatcacgcaagaaagcgtgggcgagcccggcttcctttatggccgcttcagtcacctggtgatcgtgggccaaaggagccttagcttggtccgcctgcgggtagctagtgtaggcaaccaaggaaacgccggcttccttcgcagcggcaaccacgtttaagtgttgcgtctcccgggaaactggcccccctggttgtgaggaaataaagagtaaacgatcaatgcctgccaaggcactggtcatccccgcttggtcggcgtagtcaccctggcgaatttcaattcccgccggcaatagctctcgccccttggcaacgtcgcgtacgatcgctaccacttgatccttaccaactaaatcaaccaattgttcaacggccacccgaccaaaacgtccggttgctgcggttactgcatacttcatcatttacttcctccttcggttcatatctgttactttttaaattacaacattgattgtaacatatgttattttattatcaacaaccatggccgaaaaaagaggttagaagaaaacaaggttttcttccagcctcttgctgtatgtccgaatattagacagaaaacgtggtcaataaccgcaagcctagtggctaagtacgggcaaagaacggtgctggcgcaccaaccatttgccctagcttagtcataaggctcgtcgagaaggctagtcgcactccctgataacgtgctcccaaccacaggcctagtggctaagtctggccacagaacaccgctgacgcgctaacctgtgcccgaaccttaccaacggcctgtcgaggaggttgggtcgcacttccttttttaatgattataaaactcaacgctgacccggtcgccatccatcaccaacttggataggctcccgtttgccggccgttcggtaatgtcatacttcccctcgccgaaacgttcaatcaaggacaggcaggtgttgccgtgggaaaccaacaaaacgttggccccgtccggcagccccacgtcccgaatgatcgctaagccttcgttcatccgtttccagtactcggtgctgttttcggcgtcgtggaagggatcggcgtcttttaaccagtccttggcggtgtcgatgttgtacttggtgacgatgtctttgaaggtctttaacccgtggggagccccggcgttataccaagcttggtccatataggtcccttcgtaagagccgtagaactcctcgcggaaatacggtgccgtcgtcggctccttgaccgaatcggccttattttcatcgaggattgtttgggcggtttcaacggcgcgggtaaggtcggaacaaaaggcggcgtcaaagtggacgtcctttaagcgttgtcccgccttttcggcgtcttggtaaccctggtcagtcaagggcgagttactccagccctgcagcttgttataaatgttgtagtaggtttgcccgtggcgaacgaggtaaatattgatcttggtcatcgtcatccctccattgttagtgctttcacgccttattgtaccccattttcgggttgaatgtagcggcgccccgctttgaattccgttaagtttcttcaacgatttttcaaatcccccaactccctgctccccctatgttaaaatgttgatcgttatcggctaatttacttagccccatcgctttaataacgaaattatttatgtttgcgaggatcactttacgatgaaacgactcggaaaattcgtgaacacccggatcggcttttttgcccttctggtggttctcttttgggccaagaccctctttgcctactttaccgactttaagttgggcgccgagggaattgtccaatacgccatcctgttagttaacccgcttgggaccaccctgctcttattcggactcgccttttactttaagcggtcccgcttcttttacccggtcctgatgggaattgacgttttaaataccgtcttgctctatttaaacgtcatctactaccgggaattcaccgacttcatgacgatcgccaccatgaccggctactccaaggttaaccaggggctgtcgggaagctcgattgctctgaccaacctccacgacatcttttactggctagacatcgtggtgatcttagtcttgatgctctttcgcaagatcaagttcgatccgcgggcggtcagccaccgggtcgctttcgccttcacctcggtggccctggtggtctttggggtgaacttggcggtcgcggaaatggaccggccccaactactggggcggacctttgaccggacctacatcgtcaagtacctcggcctagatacctttaccgcctacgacctagttaagaccgagcacgtcaacgacatgcgtaagtcggcgaccaaatcggagctagaaaaggttaaaaagtttaccgattcgcactacgcttcaccgaacgtcaaaatgtacgggattgccaaggggcggaacgtaatcgttatccacctggaaagcttccaacagttcctgattaacttgaaggtcaacggccaggaggtaacgccgttcttgaactccctgtacaagagcaaggagacctacgccttcgataacttcttccaccaggtcggtcaaggaaagacctctgacgccgagaacctgctggagacctctacctttggcctctcccaggggtccttgtttgccaccttgggtagtgacaacacctttgaagcggcgccggccattttaaaccagcgggccggctacacctccgccgtcttccacggtaacatcgcctcattttggaaccgtaacaacgtctacaaaaacatgggttaccagtacttcttcgacgcctcttactacgacacgtcgggtgacaagtcgaccggctacggcttaaaggataagcttctctttaaggactcgatcaagtacttagaaaacctgcaacaaccgttctacgtcaagtacatcacggttaccaaccacttcccgtttgacctcgatagcgaagataccgacccaaactttaccgccccggacaccgggagcaccacagtcgacaattactttgtcaccgcccactacctcgatcaggcggtcaaggaattcttcacctacctcgataagtcgggactggctaagaaatcaattatcgtcttgtacggggaccactacgggatttccaacagcgaaaacaccgccttggcctccgtactcggtaagaatgccgacgactggaccgactttgacaacgcccagctccaacgggtaccgttaatgtttgtcattccaggcactaacaaggggggcgtcttcaacacctacgggggcgaagtggacgtcttaccgaccctcttgcacctgctgggcatttccaccaagcgttacatcatgtttgggaccgacctcttctccaaggagcacagccaggtcgttgccttccgcaaccacgactttgtgaccccgaacttcacctcgatttcgggcacggtctacagcaataagaccggtaaaaccgctacgctgacggcggccaaaaagaagaaggtcaaggccgacgccaagttagtcaacgaagaactatccttatccgactcgctcaaccaaaagaacctcctgcgcttctacacgccgaagggcttcaccaaggtcaaggcaagtgattacaactacgccaacgggctgaagaaagaagaggcgatcgaaaagaaacttggtaacaagtcgacttcgctcattaatgaaaacggcggtaagacaaccgccgacgtcttcagtaccgatgccccagaagtgggccactcttcgactagttcgaaccggattaagattacgaacccggatgataataataattagggagcacgacagaaatctctgatttcgtcgtcgtgcccccgcaagcgccaataggattccagcagactcggctttgtcgagccaatggggtccattggcgtactgcgtgagaagtgcgactagccttctcgacgagccgcatgactaagctagggcaaatggttggtgcgccagcaccgttctttgcccgtacttaggcactaggctcgtggctaggagcacgttatcaggaagtgcgacccaaccattggtaggccgtttgaccaccacgcacctacagaataaacaaaaaggccgctcgcagcacctgctgccaacggccttttattatggatcccggcgtggtcgcggtccactttgatgtataattaacttgataaaggaggagattgtgatggcaactgttttcgtcgcccacgttaagttaagttggggccaagaggccgattatttgatcgctaacgacgtcgaaccgggcctggccagccgccgggatcgcggggataacgactggaacgccgtgatgctaaacgccttgattaacgtcccggttgctccctacctcaaagacaaccgcgtgactccgccaattgcgaccgggctggttactagcctaaccgcggtagaagcggggcccgctaccgctaagctcttacggacccgtagccagttcatcatggccgaaatgtggcaaaaacaagacgtttccgttgacgccacctttttgcaccacgaccacccccagctgagtcagtaccaaatccgtgccgacgttgattactggctcaaccaccgccgccacccactgatcactctaatcaccaagtggcgaatccggcttcagctagcccgggtcaaaaaagagaagtaggaaacagctagttaacgggccattgggctaagaaaggtgattcttccctctcccattagcaaactaaccaataaaaaaggacgcctagtggcgtccttttttattggttaatggtcactacacggttctggcgggtaatcttcccttcttcttgcaggtggcggaacttgcgcgacagagtttctggcgttgtccctaggtaggcggccaaatccttcatcttcatcggcagggtaaagcgcccacccctttggctggccaggtgggataggtaggcccacagacgttcttccaccccgtcaattaccaaaaactggttttgggcggttaattcccgcaccttggccatcgtcagttgcaagagccgggccgccaattccgggtactcggctaaaaggttggtaaaggcgtcgtaggttagttcgcaaatggcggcgtcttgttcaaccaccgcaaagatcgcttcattggcggccccgtaaagccactgctcgcccacgtactcgccagtccccagcaccgccagcacctgttcgtcgccgctttcgctgagttggtagagtttcaaccgtcccgcttcgacgatcattagctttccctcgtcgcccggggaaaggataatttcacggcgttggtagtggtggtggtgcaccatggtttcaatccgtttttgatccggcaaagacagttggttaaagagcggtaccagtgaaacgcagaggtgctcaccattgatcgtcgtcatcatcttcttgataccttcccgtcatcaaatcatttcccaggaaattttgcccggccaaaatttgcgtccgcatccaggtgtcgaggtcgactagggtgtgaactaacttcatcaacccttcttttttaccgagggcaatcgccttttggaggaagagcagttgggtgtcaaagtccttgattaggtcaaagagctggtccttgcccggagcatacttctgggcgccgttttcctttagcatcgtgtactgggtaaactgagcggttgtggtcggtaccgcctcgccattgatcactagcagttgattaattcgatcaaagtattggcgttccgtgttcaaccattcgcccgtgtactgagccaaaaagaggctggcgcagcccttggcaaacaggcgggcctgattaatcttttgttggtggagccagaggttagccaaaatgtggccggtcatcgccccggccgtgggggtgtggtggtcgacgtcagcttgctttaactccacttcgtattgttcttggatctccattaaactaactccttttccttaaccttattaacctgataaccaaggttttcgacgacctgcttcaaagcagcggccgtggtttggtcgctatccacggtcgcctttaacttaccggcgttaaagaggaccttaacctcactgaccccggcctggtgttcaaccgccgttttaatcttgtccaagcatgacgggcatgacatcccgcccaactccattagtaccttttccatgataaatcccccttttgggcttcagtataggcaggccaactcgaaaaataattgatccccatcaactttgttgaatttttaagagtcgcatcccgttgatgatcacgattaaaatactgagctcgtgaatcaacattcccgaggccatgtggacgtagccggcaaagaggccgccaaagagcagggcaacggtcaaaatggcaatcgcgatgttttggttcatgttggcgaccatcctcttggcaatcgtcagggcgaccggtaacttggctaaatcggaatggagcaagacgacgtcggaaacttctaaggcaacgtcagtcccgttgcccatcgcaattccgacctcggccgtggctagggccgggctgtcgttgaccccgtcgcccagaaaggcgacccggtgaccagctgcttggagctccttgatcttttcaaccttctctgccggcatcaggttcccgaccacctgggtcatcccaacttcttttccgacccgttcggcggtggtctggttatcgccacttagcatgatcaggttctggtaacccaacgcccgcaacttagtaaaggtcgcctgggcctcgtctttgagcgggtcactaataccaagcaggcccctcaactgaccatcaacggcgaagtaaaccagggagcgtcccgctacttgccatgccgacgccgtggtggccaccgcagttaagtccacctggtgggtagctaataatttagcgttgccaaccaacaccgtagcccctgccacctgcgccaccatcccctggcccgccagcaccttgctttcgtccaccggtaagggggcgaccgcttcgtatttgagcaccgccttggccagcgggtggttagcgaccgtctcgacactgactagcaattggtggtcgcgctcgctaacacctgtagcccaccagtcactcaccaccgcgggcaagcccttagtaacggtgccggtcttatcaaagaccagtgtgtcaaccttactcaaagcgctcaaactggcactccccttggtcaacaccccgagcttggcggcccgaccgatcccggcgacggtcgacaccggcaccccaattaccagggccccggggcaaccaagcaccaggacggtgatggctagggcgacgtctttcgttgccagtccaaccaccagggcaattagcataatcagcggggtgtagtacttggcaaagcgatcaatcacccgctgagccttggacttactgtcttgggcctcttcgactagttcgatgatctggccaaaggtcgtgtcttccccgacccggctagcttcgacaaccagggtgccatccgctaagattgttccggtgctaacggtttggtccaccgccttgggaagcggccgggcctcccccgttaagctggcttcgttcactaagccgtggccccgttttaccaccccgtcgactggtacccggtcgcccgctttcactaagaccaagtcccccgcgtccacgaagtcaatgtccgtacctccccggtggcgtcgtttacgtcggcgaggacggtggcggtttgcggcgccatgtcggtcaacgacttgacggccgcccgggttttctttagggttaacgcctccaagacgtcgccaaggttaaagagccacacgacgatggccgcctcgttgtactcaccaatgatcagggcgccaacgatggccacggccaccaataattcgatcgagatcacccggtaggtcaaggcgctgaccgcccgtaagaccagtggcaccccccccatgatggcgacgagcaccatcaagagtgagtaggcttgccccaagttagttaaacggctgagttcggcgaagatgattaaccccgtcatcgcccagacgttttgctgttggtggcgattaaagaatccttgggcttttcccataattatccctcctttgttaccttaaggatatccggtaccgcccccatttaaatcgatcggaatcaagagtaacaaaagaagtgtggaacaaccgtaaagcaggctgtggactaagctagggtgaaacgtaaaaaggcggccgacggaaagttcttccgtcagtcgcccgctttagtttaagaataatcgttagttagccaatccccatcgatgaactgtgagtagccatccgtttgtcggggtagagttccttggctaggttggtgattgccgtaggcgcctccccgaagccggtcgcaatcagggccaccttaccttcgtaaacgaccccgtcgccgattgcgtacaccccaggaactgaggtcttcatcgtttggtcgaccttgatttgcccccgttcgctcgctaggtccaaagaccagtcctttaaagcggcgttattggaggtgaagccgtagtttaccaagaccttatcaacttcgagtggtcgctcttcgtcagcgcgcatcttcttgaggttcaaggtgaccgattgatcggcgttgacggttaagtccttgggcaggtacggggtcaacttttcaatcgttgaggcctccagttgggcaacggtgtgttcaagggcccggaaagcatcgcggcggtgaaccaggtaaacttgctcagccacgtcttctagcatcaaggccatgtcgatggcggcgtccccaccaccgaggacggcaacgcgttggtccttaaagtcttccttgtggttggcaaagtagcgtacctgtttgccctccagttcttcggcgccgggcagggccagcttgcggggactaaaggcgccgttacccatcgcaattacaatcgacttggaggtcgacgtccgcttggcgctgtgaatggtgaaggagccgtcatcttctttgaccacgtcggtgaccttttcgcccaggaattgatcgaccggcgccacttcgatttgggctgctaggtcatccgccagttcctggccagtgaccccagccttaccggccacgtcccaaacccgcttttccgggtagagggcggcgggttggccccccagttggggcagtgcttcgattagttgggcctttagctggtgtaggccgcagtaaaaggcggcgaacatcccggccggacccccaccaataatcgtcacgtcatagcgttcttccatcgtttcttcctcctcgttttggttaccctgccgattataccacgcccgcttttctgaacaattattatgaatgttcggactttcttgattttaatttgtatttatccggtgattcaagtatcattgaaagcgaaattacaatcctaaattatacgttacggagggttttataatggcacaaaagaaaatgattttggacctggacaccggggtcgatgacgcactagcaattgcttacgcggttgctgcacccgacgttgatttgatcgggattgtttcttcttacggaaacaacctgctcgacgtctgcgctaaaaacagccttaagttgctagaactgctcggtcagaccgatgttccggtttacaagggtttacctcactccagcaccagtgatcatttcgatgtgatgcaagtttccaaggacatccacggtgacaacggaattggtgacgttgacctgccagaaccaaagcgggccttagaagaaatgtctggggtcgacttctacattgaagccgcccaccaatacggccaagacctgatcatcattccaaccggcccgatgaccaacctggccgccgccctggaaaaggaccccgagattgcccacttgatcggcaacgttaccttcatgggtggggccctgaccgttgaagggaacgtgaccgacgtggccgaagccaacatcaaccaagatgctaaggcagccgacgtggtcttacgaagcgacctaccactgacgatggttggcttggacgtcactttgcggaccctcttaactaagaaggaaacccaacagtggcgcgaactgggcaccaagtccgggattgcctttgctgacatcaccgacttttacatcgatgcctactacaacttagacatcgacaagaacggttgcgccctgcacgacccactggccgtcggggtctccttagacccaacctttgtgaccacgatttccctgttcatgaaggtaatctacgacgaacacaactacggccgtacgattggggacaaggaccgcttaaacgacccgaacccgaataccaaggtggccgtcgacgtcgacaaggagcgctacttagccaccttcatggacctgttgaccaacttgtttaaggaacactaataggaagtgcggaacaaccttctcgacgggccatgggctaagccaggaagtgagcgaaataatgctcacttcctttttctttgtcctccacaccactctccgttgtcttacgatgttacccgttttcgtcacgccacgttccgtggtcttagtcttttggtaacttttccaccgcttttccacttttccccaaggggttgtggataattacggacttatccccaagatatgggtagtcctttttccaacctagtcagagcgctcccgttttttaacaaggcgtggcgccacgaaccgtcctaagcaggcgatcggtaagcattttcttgcccccactaccaaaaacaggtatgatggtcttaaatcatgtcttgtctggggtgccattggctgagaaatacccattgaacctgctttggttaggaccaacgaagggaacgacaggtaatcaccgtcaaaaatcagccaccccatgtcccggggtggctttttctttgggcaaggaatggtaaaaatttttggaggaatgtttctcatgaataaatcacgtttcggattgcgcgacgtcatcttacttgccctaatcgggatcatcttcggggtgatctactttgccggcgactttgtttacaacgccgttaccttagccctgacgccaatcggcctgggggcggccggcaacgactttacaatgggcctgtggtgcatggccggaccattagccggtttcatgctcaagcgcccgggatccgcctttttgggcgaatttctcggggcggccggggaaatgtttttaggcggccaatggggggcttcgaacctgatttccggggcggtccaaggggttgcttctgaactcgggttcaccctagttggctaccggatgtacaactggctgacgatcctgtcaacgacggccaccaccaccatcctaacctttgcctgggactggttccgtaacggttacagccacttcgccctgccgatcctcttagcctgctttgcgattcgcttcatctcgatgtttcttttctgcggggtcttggtcaagttgatcactaacctcttggaacgtgcccacgtcatcccgcaagcccaggcctaacccatggaataccgtatccagcacctaaactttgcctaccaagaggaaccggttttagtcgacctaaacctaaccctgccggccggggagctctacctcttttccggcccttctggtagtggaaaatcgaccctcttgcgcattatggccggcctcttaccccggtacggagggaccttaaccggcgaggtaagtggggtcgaaccgggcacggcttccttgatgtttcaggacccgagcctccagtttgccctcgacaccccgcgccacgaggttgagtttgccctggaaaacctggcgcttccggccaaccagatcccggccaaggtggaacaagcgctgaagttttgccaggccgaccacctagccgaccggcgcttagtaaccctgtccggtggtgaacaacagctcgtcgcccttgcgatcaccgtggccatggatagccagttgatcctcctggacgaacccttcgcctccctcgatcatgaccaccggacccaattgttggcccgcttagtggagcttaaaaaccagggcaagaccgttatcatcgccgaccacaacttacagggctaccgccagtaccagccgaccgtgatcgcctttgaaaaggggcgctgtcgcttattacaaggcgaagaggcaacggagcgctttgatcaagccgagcaactagctaaaccactcccagcttacttgccaactgaagggaccacgcccctcttttccctggccgacttaaaactaattacgaacggtgcaacactgttaaccatcgaccagctaggcctctttaaagaccgggtcaccctgctaaccggggaatccggtagcggcaaaaccaccctctttcgggccctgaccaagctacgcccctacctaggttcggttacctaccagggccaagaaatcaaacaggccaaggcggccccgtacgcccgccaagtcggcctcgtctttcagcgcgcctctgaccagtacctcaacgtgacggtcaaagaagaactggaacttagccaacaacaggggcaaaacccctactttaccccggaacgggtccaagctgccctgaaaaaactggggctgaccgggatggacgaacgggtcgtttactcgctttccggcggccagcaaaaaaagctccaactgctgttgatgctaatgatgggccaaccggtcttactcctggacgaacccttcgccggcctcgacagtaagtcgattgaagtggtgtgggagctgatcgacgcgagccgccaagtttggccgcaaacgctgatcatcatcagccaccagctagccgggctggccaaccacatcgattaccgcctccacttagccgaccaccacttaacttaccaaggggaggtgcaccatgaatcctagtctgcaactgctgttggttctcctaatttcctttgaggtctcctttaccagccgcttaacggccaacctggtcttcttagtgattgccattttcgtcttattggcccaccgccttcactggcgccagtggctgcggctgctggctggccccttcttaccggccctggccctctttgtgacgattgttttctatagccccggccacgaccggcactttggcttcgtcttagtcagccggatctacctctacgtaatgctaggggcgacggtgacctttaccaccaccccgctcaaattggcccagtccctggaacaaaccgcccacctgccggctaagtttgcttacgggaccttgtcggcggtcaacctcttgcctaagatcaagcaagaagtcatccaaatccgggcggccgctttaatgcgcggcgtcaccctccacctgtggtcacccaccctgtacttcaaggcgatcctggtggcgattaactggtccgaccagctggcccaagcgatcgaatcgcacggctttgtcgaaggtaaacaacgcaccttcgcccaccgcatcgccgttcactggtacgactgggtgctcctcggcggcggaattataattttacaggtgctcttaattgcctttccctaggcttttaggtatgctaaaagaaaagttttgggggaggagatttgatgaacgagcagaccttaacaaaccgaatcgtggggggcttaagctacctggcagtccttttcttgccagtcttatttccgctgatcgtttggatcgtggcccggcaagataacccgccgttggcccaccatggtaaggtcgccttttggactcaactggcgcccttcttagtcgtcatagccttgctagtgatcgtcgccatcttaaacgcagtcgggattagcaccagccaccataccatcaccgggggcgccgcctggttaaacatcctctgggtggttgccctactcgtcggtagtgccgccctctttgcttataacattgtcatggccgtcctcgtcttcttaggtcggcgttaactttttgcgttgttacaaataatgcggaagccacccacccttgcttagaagggagttgtttccgcccatttttagaaaggatgataattcttgtcgacgatttttgggatcttaatgctcctaattgccgtggtggccgccaacgtcttacacctcttgtggccccggctgccactggccatctaccaaattttagccgggattatcttggccctgattcccgttcaatcccacacctttgaactagatcccaaaaccttcctcttgttaatcattgcccccctactctttaacgacgggcagggaacctccccacgcgaactatcgcgtaacctcaaacaaacgctatcaatggcggtcaccttagttgtcttctcggtactggtggtagggactggcttgcacttagcgatggcggagaccttctccttaccgctagccttcatgttgggggcaatcattgcccccaccgatgcggtcgccgtcaagtcactatcggcaacggtggcgatgcccagaaacgtcaaccggaccttagagcacgaagccctttttaacgatgcatccggcctggtcttgttcggcctggccacctccaccctgtcatcggggcacttttccttagggcaggggatcttcaccttcctctacgtcttcttaggcgggatcatctttggggcgctgatcggtttcctagccatccaattgcggacaaccttgatgcggacccacgttgatatcgggcgaattgtgatcccgatcaacctgatgactccaatcgtcacctactggtttgccgaggaactccacttatccgggatcctggccgtggtggccgctgggatcgtccacgccctcttgtacacccgcttgcggttgacctcggctaaggtccaaattgcctccaccacgatctggtcgatggtcgctgacattttaaacgggctggtcttcgtcttcttgggggtcaccttgcccagcgtgctcggtaacacttccctagcgcgcctagccaagattttcgtggtcgccattgccctctacttagtaatgggggcgctacgctacttctggagccaactcaagttcgttgacctccactctaagaaaaagcagcgccaaaaggacagtttcctactctcccttggcggaatccacgggacgatcactttagcgatggccttttcaatcccccacaccatcaacggccaacccctagcggcccgcaacacgataattttgatcgccgccctcgtgatcatcatcagcatcacggtcggggcgctcgcctttccacgcatcctaccggccaaaaagaagagttaccggcaaagcgagttccattatcaacttaacaagaccgtccactacgccatcgaccaactcgccaatgaaccgggcggggtggccgaaaaagcggtggtcttaaacgtgttatccagccaaagcaccctaacctttaagaccaaccaggcccgcttccaaaggatttatgaccgggcccacgaggtcgaactcgccgcgatcaccaagctcagtgaagaaggcaaggtgaccgacaagatcgcccgcctgtacgtcgggttgatctcacgggaactggctagccacggggacgggctgatcaacttctgtcgggggatttactaccggatcaagtggcaccgggtccgccaccgggtttcgcacataaccccggcccaaaccgcctacttcaagcgcgaggtcgccccgatccagcaacaggtcgcccgcgtctttgacctgatctacccccaagtcatcgcctacctgaatgacatccagacccccgccaacacccacgaggtgacgatggtccggcgctcctatttcaaccgccagcgtttcttccgccagcacgagcacctcgacggcgagcaaatcgacatcctcttcgtggcggccttccaatttgaacattcctacatccagcaggcggccgccaaaggtacgatttcggttgaactggccaacgcccttaacgaacacatctccaccgaccagttggtgtacattcaatcgactaactaggaagtgcgacccaacctatcaaacaggccgtgggctaaggataggtcacaggttagcgcgccagcggtgttctgtggccggacttagccactaggcctgtggttggggagcacgttatgggaagtgcgacccaaccgttagccgccattccccttataacatttggtaacccacctaacgaaaaaacgcccccgtggttaaaaccacgacgggcgtttttgattcccgggtaatttcccgagaaatattagggactactgacgcttgcgagggtgcgattactacccaactactcttttttaaaggcaacacggcagtacaccaatggactctagcagttcgtttcacgaacctagctagagtcctattggtgcttgcggaggcacgactaagaaatcagagatttcagtcgtgcctcattcctgccggaccagcaggtcgacaatttcgtccttggtgatcttaccaaagacccgggccaccaagccctcgtcaatcttttggttgatggcttcccggtcgtagcgaacccccaacaaacgctgttcaaaatcgcgcacgtcttcttgacctaagaagtcaccatagaccttgaggtaggcaatcttaccgccctcaatttgaaaacggaagtcgaccgtcccctggtcaaagtgttggcggtgttggatggccgccttgggcgacttgccgtatacgaagtcccagttgctaaagatctccgcgttgatcttggccacggcggccttgtcttcatcactcagcacgtattccttggcatcggctaggtcactgacgccgaggatcttcttggctagcgtgtcgcggaattcctcaatcgtcaggtgttggtaggccggcgtgaagtggggctttaggttagttacccggctgtggaccgacttgatccccttggattcaatcttgtccttaggcacattaagggcgtggccaatcacgtcgaggtcgacgtcgtacatcagggtgccatgggagaacatccgcccgtgggcgatccgcatggcgttgccggagaacttcttaccctcgatctgtaagtcgttgcgcccggatagttccgccttggtcgcccccatttcgtgcagggcctcgatcaccgggttggtgaacttagcgaagttcccgttagagtggccgtcgtctttggtgatgaagctaaaggaaacgttgcccaggtcgtcaaagaccgccccacccccggaggtccggcgggtaacgatgatgttatgttcacgcacgtaatcaaggttgacctcttcataggcgtcctgattgcggccgagaatgatgcaaggcgaattgatgtaaaagtagaggatcggctcatcgagttggacgtgctccatcaggtaggtttctagcgccaggttatagcgaatgtccctggtatcagtgactaagtacttcatgatctcctcctctaaaatgcgaattgcttaaccaggtgcaccctgacgttttggcttgaaccaacgattttagcaactgggcagcggcgttcgcacttggccaagatctcttgggcctctgcttcagcgacttggggaatccggacctggcagtccaaaaagaactggtagccctcggtatccttgcccatgtcaacgccaaccttaacttcggcggcgtgttctagtccccggcgcccctcttcagcttcgatcgtggcgtttaaacaagtagccagcgctaatcccaggagctgttccgggttggtccccgggtcatcctggagcgggctggacgtcaaaacatctaagtcaccgcccagggtcacgcgggcgtggccgtttaaaccggcatcattaatcacttcggtatggtataaagaacgaaaagtcatcactttgccctccttatgaatgcgtttgcacccattatacgctgaactgactaaaagaaaagggaagtgcgttattggaagtacgcaccaaccaattggcaggccgtgggccaaggatagggcacaggttagcgcggtacgcggtgttctgtgtccagacttagccactaggtctgcggttggggagcacgttatctgtacaacaaaaagaggttagagaaagatttaccctaacctcttaatatgtatgtccttcctctagctaagaggaagggtgaacaactatgctacatcaagtggctaatcttgattatggtagctagccatcgtgtgtttacaactacaccttagtgtatcaagtagggcttagcaactatttaatatacttctccaaaaagtccttcacgtgctcttggtaagccgctggggcggtcgcaaaggacttagcgtgaacggctcccttgaccaaccacagttccttgggacccctagtcgcggcgtagttttggtagaccatcgcggttgggacaaaggtgtccttggtaccgtgaatgaagagcattgggcgatggttgtggtgtagggacttcaccgaactagcctggccgatgaaaaagccgttggcaacccggttgatcccactcatcgtcttgatcagcggccaggcgacaaataccggcaagccgtacaggtccttagcttcgtgcatcagttcggcgttaacgctagtgtagccacagtcttcaatgaaggccttgacctggctaggcaacttgatgcccgacgtcatcatcgtcgtggcgccccccattgagaccccgaacatcacgatctgactatcggcgccgttttctttaatcagacggttaatccacttacgttcgtcgtagcgttccggccagccgtaaccgatgtatttcccctggctatcgccgtgggcccgggcatccgggatcaagacgttgtagcccagctggtggaacatcgcggcgtaggcccccatcgaatccttgttattcatgtaaccgtgggcgatcaggaccgacttattggtcttcttggccgccggaatgtaatcggcgtccagcttcaggttgtcggtcgccgacttcatcgtccaaacctgcttaggggtcttttggaaccacatcttctgggcgtaaagcgggtcggacttttcaatcttggtattgttgttaataaaggacttgtgccccgccaccattgcgacgttaaagaaatacagggccgcccctaaaaaggcgaccactaagagggtcactaagccaccgaccacccagggccagcagcggcgtttgttgctcgttttttgcatcgttttctcctcaattttcaatcgtttcattttaccacgctgtgtgggtaatcgtcatttgcttttctaagaccacggggcgtggcgtgaatggtataataaaactgaattgaggaaggaagtgtcgatatgtttccagaacgactccgggccttgcgcgccggacaaaaaattaccctccaagaactagccgacgccctgagcaagaacttagccccgggtgaaaagcctaactccccctcccaaatcgggaactgggagcgggggatccggaccccgtcttacgttgaggtccgcaagctagccgagtactttaacgtcagcctcgactacttgaccgggcgctccgaccacgacgaaaccgatttggccaagctcttttttgataccaacaaggccctgaccttcaaccagcggaccctaaccggcgaggaccgctacgaaatcttccaactgattgacggctactttaagggccaggccaaccgtcgcgaaaccgccactttctatgcccaacaagaagaactgaacttaaactttaaggacgaatcatgaaccccaaaaaactccgccaactcaaaaaagctactaaaaaggcccggaccacggccccagctccctacattgcacaactaacccgctaccgggacctgtttgacaaggtaccccaggtcaagtacctgctcaacgccgccttgttagacgaccagttgttaaagtctgggctcttgccccagccgttgccgaagttgctcttgcccgatgacatccaaaccgtcatcttcaaccagcttgcggctaagtacccccagggcgacgcaaccggcgaccgcttgtgggaccagtacacggccgccctgcccaaggttgacgccctcttgcgcgactaccgcgactacctagaggaaacctacggaatgtggtcctttaccaacgtctcctttatcagcagcctgagtgattatttaaagggcgcaccggtcttggaagtgatggccggcaacggttatttgtccaagggcttaaaggacaaacgcccgacccaaacggtgttcaccaccgattccacggcctgggtcaaggagaaccaaaccgggcgccatccggtcatttcaattgaacccttagacgcgctcgccgccgtcgacaagtacgccgaccaggttgaatacgtgatcatgtcgtgggccccggacaagggcgaggccgactgggacttgttagaacatttgcgggaacactaccccgccctcaagctcctcgtgattggggaaaaggacggcgccaccaattccaagcgtttctggcaagaagcccagctctcccaagacggcctagcccaggttaacgccgctctaaagtcctttgacctgattgatgaacaggtttatttagctaaataaagaagtgcgatccaactcctagtaagcatcttactatcttcacgaatgttgaacagaaaacgtggaaaataaccgcaggtctagtgcctaagtacggccgaagaacggtgcgtgccgcaccaaccgttcgtcctagcttagtcatacgacctgcttcggaggttatttcccactcagcaatataaaaacgccacccgcttctccgtggagaagtaggtggcgttttcgtttggcaaacgtggcttggcggccacgtggatgtgtattgatactatctcaggtcgcaccggtcgtccactaccagctggaccaggcaccctacaatccggtaggttacgtgccccactcgagaatcatttccgttcgcacgggggaaccaaataagggtcggttccctgacctctcgactcatcgcagtctttaccataccacgattttaagcttccggcaaggctaatcgtcctcttcttgggcggcccggttttgggtcaaggcgctgagctggttaaccagccactcacctagcggggtcacaaaactgtttggctggtcgctaacggcgtcggcgtcccccagttcatcgatccgcaggccggattggttaagctgttcgccctcaacgatcatgtaaaccttcaccgggtaaggctggtcccgttctaaaagcttggggtctaagcgctgtgcttcggccatcggcacgttgatcaggttcatttctaggcgcacgctgactgggtcaccaaccggcactttgacctcccagttgtactggcttaagtgtccggtcgcgatttgctcggccatatccattaaaccggcctttagggtggttgcttgctggacaacggcggcgctcacttgccccgtggtgacgtgtacccgttcgctctctaattcccccaggtattgttcgtaggtcatttccattgcttgttacttcccttctaagcgcgagtaggtgtagttgagccgctggcgaattccttggataatcccggccaccgccacgacgattccgcagatggccaccagttggatcaacaggccggacatggcggagcggtcgtgcacttgcaggagccccccgaggttaataatccccaagtagaggttaaccagaatcgtgacgtaactagacaggcggacccgcaaggccacgaagattaccaccaggacggctagggccaccaaaaagcccacccggcctaagacggccgctgaattccaggcttggccaacctgggcgtacatacaaaactcaatcaccgccgccagaaccatggcaataatggtgtaggcgatgatcttattcgcgttcgttgtttttttcattttgttccccttttgctaatcttcccctattctaactgatcaacctgtaaagctcaattttcctcccgccccgggtggcgtataatataggtgaaagcatgaatggaggaattgttatgacaaacggaacttaccaacgcatcttagtccccatcgacggctcccgggcgaccccggtcgtcatggaaaaggcgattgccgccgccaaaaagcaccaggcccacttagacatcctaaacgtcgcccaggttaaccagctgaccgacggctacgcgattgccagttcgctaagcaccagccaaaccttcgacctggttaaaacgacccaggagcggctgggcgacttaaagaagcacgccgaagaaagcggggttaaatcggtcgctatccacatccgctttggcaaccccaagcaggtgatcgcccgcgactttatcgccgaccaccacaacgatttaatcgtgattggtaccaccggcctgtcgatggtcgaacgcctgattgtcggctcggtcactagttacgtggtccgtaacgccgcttgcgacgtggaggtcgtacgggtttaggttttgaatgaaaggacggcgcccctatggtttcgcatcaactgacaatttcccttgacgaagatgcctttcgggcccttgaaaagagggcgcaaagcgaacgacgcccactagaagaggtggcggcttccatgctgaccaccgctagcaaggtcccggcgaccgggatgaccagtttagaggggcgcttcgtggttggccaaatcgtcaccccatctgctttcgaccccaccgagccactcgtcttggtgcgggggatttactaccgctaccggattgcgggcaagccacaacccggccaacgtttcgtggtcaccgcagtcaaagataacgtcttaaccctcacccccaccaacgaaagcgaggatgatgcctgatgtttttctcccttgtaatcgtatttatcatcttctttctcctttacggctacttcgccgctaaaagcgaggccaagaaaaaaccggataacccaacggcgccagccaagcaaaacactaaccgccccgtcgccaccggggtttcccaccgcagtgccaaacacacaggaggttttagcatgttcggaattgccatcgtcaagcaaaacacccaagggctgattgaaaccttagggaagtactcccggactgtcgaagccggtttacacctgtacattcccctggttcaacacgtccgccacgttagcttggccatgcagcccatcttattgcaaaagtacagcgtcatcaccagcgataacgccgacgtacaggcctcggtttcgttaaactaccacgtcaccgacgccgttaagtacagctacgaaaacaccaactccgaggagtcgatgatccaactggtccgcggccacctgcgcgacatcatcggccggctggaattaaaccaggccctcggttcgacttccaacatcaacgcccagctggccgctgcgatcggcgatttaaccggcctgtacggaattaacgttgaccgggtcaacattgatgaactgaccccgtcaccggagatccaaaaggcgatggacaagcagctgaccgccgaccgggaacgggtagccacgatcgcccgggccgaaggggaagcccgcaacatcaagctgaccaccgacgctaaaaacgccgccctggtcgaaaccgcccaggcccaagccacggcgacgcggaccaaggccgacgccgaagcctaccggattgaaaagattcgccaggccctgagtagcgttgacgacaagtacttccgcgaccaaagcctactggccttctctaagctggcggagggcaacaacaatttagtggtgatggataaagacgacatcaccgaactaggtaaggtcccggtcgctaaggaattgtgggacgccggcaaaaacaaataaagcaagaaattactcctagagataaaacagccacccaattcgctaagttacgaattgggtggctgtttcatttagaggaggttgggtcgcacttccataacgtgctccccaccacggggctagtgtctaagctggccgaagaacgatgcgtaccgcatcaaccgttcgtcccagcttagccatacgccccgtcgaggaggttgggtcgcacttcctaatttccgttagccgcgttggccttggcttccatttgcatgatcttgcgttccttgaagaccaggtaaaccaagagcaaaaaggcagcggcggccgccacgtaaatcgtcgtcgccgaagcgccccaaccaaagtggtcgaccagttgaccgatcagggccgtcgcggccgtttcaccgaagacgtattggaagaagcccatgaacccggtcgacagcccaacggcgtagttcggcacggcttcgttgaccattagtcccactaaggacagtggggcgtaaatcaggctccccataatgaagaggactaccgtgattacggcttgactggtgctagtaaagtaagtgatcaggcaggcaatcaaaccaatcacgcagatgaaacaaactaaggaacggcgccccttcaagaagtcggagaccaaccctaagatgattacccctggcacggccgaaagttcaaagatcccgactaaccacttggcccagtcggcggagaagcccttggtcggcaggtaacttgggatccaactcatgaccccgtaacggacaatgtaaattgacattgacgtcaaagtaacggcccaaaccaccttgttagtcaagatgtcttggaagaggatctgggtgaaggacttttgggaaagttcttgggaggtagcttcccccttttcgtccagttccacgtaaccagagtattccgccatgtttggcagccctactgcttctggccgttccgagttaataagcaacattaaggttgcgataatagctgagataacggaagcggtcaaaaaaaccatcgttaaagaacctgagaagagcagggtggccatttgaatcacggccacgcaggcaaaggccccggcgttgtgggcagaggcccagatggagaacatcgtcccccggttcttcttagcgaaccagagcgagatttcacgttggcaggccacggcccccatggcttgggtcacggccactaagatcatcaggaataagatgatgtaaaagttcttggtgaagcccaagaaggcgttgaaaatacaagataggtacagcccggaagccaagaaccacttggtgttggacttatcggctaagccccccatgaacagcttggccaccccgtaaccaatcccaaaggttgataaaatcagcccaatttgaccgattgaaaagccgtacgcctccatgatcggcttttgttcggtggtgaaaatcagccgaatgatgtagtaggacaggtaggtaacacaagtggcgactaagacccccgcctgacgcttgcggtattcgccggcgaccttttctttaggcaccagtttcgttgcgtccggtgacggctttaagaagttaaacatctaatcactcctattctgtttgatgtccccaccagcagaatagttacgagaggaccgaattaaaccagtgctcatctatgtatttcccgggaaattaccccggggtcataaattggacggttaaccgagttatctacgaacttgacctgcgagtggtagcgctttcatcaaccgtattatatatggattatcgaccaattgcaacgtggtttattgaatcacaggtgttttgacggctaggtaattcgttttatttaaatgcttatactcccgaaaaatgtgttccggcgtgaagcccagggctttaacgacttcggctcccggcccgctaataccaaaccggtcaacgcccataacttttccgtttaagccgacgtatttgtaccacgactgactggcacccatctcgacagcgagccgccgggttacttgtggcggtaagaccgcatctcggtacgccttcggttgctcatcgaaaaggttggtgcttggcatcgaaacgacccggacgtcaatcccgtcatcgaaaaggagctcgcgggcttgtaaggctagggcgacttccgaaccggccgcaatgataatgccgtccggcacctcacgactcgaatccgccaacacgtaacccccccgctcgaccggtgcgtccaccgtttcttctagcaccggtaagctttggcgtgacgccactaacaacgacgggcggtcggtcgtccgtaccatcacccgccaggccgcggccgtttcgttagcgtcagcggggcgaataacgttgaggttcggcatcgcccggaagctagccagctgctctaccggctggtgggtcggcccgtcctcccccacggcgatcgagtcgtgggtaccgataaagatcgacggcaggtgcatcagtgccgcttggcggatggcggcccgcaggtagtcggtgaagactaaaaaggtgctcccaaaggcccgggtccccccgtggaggttgatcccgttgacggccgcggccatcccaaactcgcggacgccaaagaagatgttcttgccggccggggtgtccttaccaaaggtgccaccgccgtccaagaaggtcttgttcgagctagccaggtcggccgccccaccccagaactgcgggttggcgccggccaccgtttgcaagacctccgcactagcttgacgagtcgccaccttctcccccggtttacgggtggtcgctacccccgtcacacttaattgcgggttagtcaactggcgggcttcctttgggtactgagcccggtaggtggcaaagagggcttgccagttgtcgtaggctgcccgcttattagccaccgcggtttcgaagcgttggcggatcgccggggcaatttcaaagggcgccgctgaccaggaatagaagtcggccatcgcttgacgcccctcttcccccaggggagcgccgtgcaccttgtttgtgccgccattcggggccccgtaaccaatcgtggtcttaacttcgatcatggttggctgcgtgctttgctgggcctgcttgatcgccgcttcaatcgcatccagatcggcgttgccatcgtcaaccaccaggtactgccaaccagctgccgttaagcgttggcgtgggtcctcgtggctactcaagcttagcgggccatctaaggaaacctggttggagtcgtacaagacgatcagcttgcccagccctaattgaccggccaggttgattgcttcctggctgagcccctccatcaagtcgccgtcaccggccagaacgtaggtgtagtggtcgatcagcggcaggcccggccggttgtagacggcggccaaatgcttttcggccattgccagcccaaccgccatccctagcccctgggagagcgggcccgtcgaggcatccacccctggggtccagccgtattcggggtgaccgggagtcttggagccgagttggcgaaaagccttcaagtcggcgagcgacaggtcaaacccgttgaggtgcaagaggctgtataacaacgccgagccgtgccccgccgagaggataaaacggtcgcggttaagccactctgggtcgcgggggttaaagttcatcacccgttcccacagggtgtaggccatcggggcggcgtcaatggcaatcccggggtgaccgctgttagcttggttaatcatatcgacgctcaaaaagcgtagggcgttaaccgccagcatttcttctcgttgcattcttccccctccttacttaaccgggtcagcgacgtcatcgaggatgctaaagcccagtgcctggatgtcttcttcaaaaccacgcaccgtgtctaaggcgacgtcggccggcgtcatgtcccggcgcgatagccacttttgcaggatcgtcggtggtaccgtgatgatgtctaagccggattgttcggcctggcggatgttatcaacttcccgggtcgacgcccagagcaacttcacgttggggtagcggtatgacattgccgagctgcaaatcacaaaggaagtcggatcaaccccggtgtcggcgacccgcccaacgaagagggacacaatcgcgggcacctcgggatggagggcgtctaaggcccagcgcacctgttccttggtcgtgatcgccgttacgttaagcttgatcccctggttggagagttcacgcaacaggttgatattgggttgcccatctaaggataagatcggtaccttgacgtagacgttgggccccaaagaggacaggatcgtggcctcttctttaatctgatccgggtcctgggtgaagacctcaaaggaaaccggcatcgacgggaactcggcaaccacctgcttggcaaaggccaggtagttggttaccccagcccgcttcatcaaggacgggttggtggtaaagccagtcacttccggtaacttggccatttcacgcatgtcattaatgtcggccccgtcggcgtaaatttcaatcgttgcttggttcgtaaattgcataactaaatcgctccttttaagagtataccaatttcaaattattaagttcgtcatgcttcatatcatgcacgtctcacccaactgggtcaataacctttttgtaaattggagcggttcatttgttaagaccaattatgtttaattcgcttatatcaaccgatttagcgatgaaataaaacccatttagcgccaatttaattggatataccattttaaaataaggacgctattttttcacccaagcggttgcgaaaattttataatcgccatataatgaatgatcgattattcatagatttagccaaaattaaaattagaccaatctgaaaatttcgacaaaaaaaggagtgcacgcatgttacactccttttttgttagcaaaacctattttttatcgcgcgtgtagaacttccgggccgtcttggcgaccaacgattacttcgttgacccgatccaagaagagaccgtgttcaacaacgcccacggtgtgaataaggtcctcagctagggtcttcggggcatcaatcttccccatcttgaggtcgataatgtagttcttttcgtcagtcaggtaacggttatccccgtccatccgccactgcggttggtagcccttcttttcaaacttgcggaaaacgtgggccgccccaaacgggattacttctactggtaccccaaagtcgccaagcttatcaactaactttgattcgtcaacaatccaaatattcttggttgaggcatcgttaacgaccttttcccaaagcagggcgcccccgccccccttaataccttggaaatcgttgctcacttcatcggcaccatcaatggtaaggtcaacgtgatcaacttcatcaatatctttgatcgtgatccccagttcagttgcttgcttggttgtccgacgtgaagtagtcaccccaacgatcttcaaaccttcgtttttaactcgttcacctagggcatccaccatgaagcgaacggttgacccggtccccaacccaacgatcataccatcttcaacgtacttaacggcttcttttccaacgagtgcttttaattcattttgatccataactatgtcatctccaatgtttagttttacattaaaaaagaccgggaaccccggccttttttacaagtctaagaatgcgagtcattccgatccgctcattacttccaggttcgctattgatcattactgtaaggtgttgtaaggagagtaactaacgatcactgctcacacggttttaactggccggtaacttagtaatcacaatgacttcgcatccttgagacaacgaaattaactatcaaccgtggtcgattggtattaatggattttattttatcctagctgacagttaattttgatcttcccacattttgttgaaaacgtcaacaacgtgatcaacagtgaagccgtagtctgcgaccacttccggtcccttcccactcttaccaagagtgtcgacgccgacaactcgaccgtcaaggcccacaaattggtaccaagcttgcgtgttccccatttcaaccgccagtcggtgacgaacaccagtcggtaagacttgctcttggtaatcagcggattgttccttaaagcgttcaatacttggtacggaaaccacttgaatgtcgtagtcgccttgcttttgaagctttgctttaacttctagggctaaggaaacttcggaccctgatgctaacaagatcccatctggttcttgcgtcttggccggcgaaatgatgtaggcacccttttcaacgtcggcgcccttcgtttcatctaacaccggcaatttttgccgtgatgcgatcaaaacgcttggcttatccgtcgtcttagcaatcaccttccaagcttccactgtttcgtgcgcatcagccgggcggaagacctgaacgtttggaatcgtccgtaacattgccaactgctcgattggttcgtgggtgggaccgtcttcaccaacggctaaggagtcgtgagtaaagatgaagattgatggtaagtgttgaatggcagccttaaggtagtcactaaagaccataaaggtacttacgtaagcacggctccccacgtgaaggttaatcccgttagttgcggttgcggccccgaactcacggaccccgtagtagacgttgcggccggcgtagttgtcgggcgtaaagttgccatcgtcctttaaggccgtcttgtttgaggaggccaggtcagccgctccaccccagaactgtgggtttgccttggcaagttgttgcaagacgtcggaactggcaacccgggttgccatttgatcaccagtttgatattcgtcaaccaagtcggtcacgtctaacatgttagtggtcaactgagcgtatcctgctgggtattcttgcccgtacttttcaaaaagctttacccattcatcgtacaatagccttaaaagttgtcactttaaaagtcagtggtggttgacaaagctaaagaagtcatcgactgactccccgcgcttgagctgggccaagcgaacgtcaatcagttcacgcacccttataaaaaccgccgcggtcatccggtcggtcaaatcgtacttatcttggtagtggtggtaaaaggtctggcggttaatcagtgccgcctgggcgatttgcgtaaccgtcaccgcccgaaaactctccttttccaacaggtctaagtacgcttcttcaatcgttttttgcatccgtttggcagcttgggttaccatcttgatccccacttttcgttaagtgtcagcaaaagcgacaggtgtcacttttagttacaacgttaagattattgtgacttgttgcccccgccttggcaagccataataaagttaatcaaacgcaaggggggacctttaatgaacgaactaatcaccattacggctttaaataaacagttcggcgcccagaccgttttaaacggcgtcgacctcaccattacctcggaaaaaatcatcggcctgatcgggccatcgggggccggcaagaccactttgattaagaccaccttaggaatggaaaaagccgacagcggcacgtccctggtcctgggccaacaaatgcctaaccgtcagatcctcggccaaattggctacatggcccaaagtgacgccttatacgagaccctaaccgccaaagaaaacctggccttttttgcccaactgaagggcgttgaacgtcatcaattaacggcggaatgccagcgcgtcgccaaggtggtcgacctaagcaacgacttaaccaagcgggtcagcggcttttccggcgggatgaaacggcgcctgtcattggccatcgccctgctcggcaaaccccagctcttaattttagacgaaccgaccgtcgggatcgacccggccctgcgcctcgaaatctggcgggaactggaccggatgaaaaaggatggctgcggggtgctggtaaccacccacgtgatgagcgaagccgagatgaccgattcggtggccctcttgatggatggtcggatcatcgccaacgacgccccggccgccctcaagcaatcctacggcgttggctcaattgaagaggccttcttaaaggccgaacgggaggtgaacgcacatgcgtagcttagccatcaccaaacggatcttaaccgaattgatccgcgacaaacgtaccctggccctgctctttatcgcccccattttaaccatgtggctcctatcgattatgttttcagccaccactgatacccacgtaacgatcgggacggccaacctttcctcgtcgttagtcaagcaaatcgacgtcgtcaagcacgtctcggtcaagacttacgccagcgctgaccaggccgaccgagccctcaaggactaccgcatcgacgccaccgtggtcaaaaccagcgccaatcactaccacctaacctttgccaacatcgactcggccaagaccgctttgaccaagcaagccttccaagtcgccctgcaaaagagcaatgcccaccaactggcggccaccatacagcgactggtggcgatgttgccaacgacggcgcaggatcaattcaaccaggggaccgcgagcgccacgacccacatcaagtcgacctaccgctacggtgattcttcgaccggttacttcaccaagatcttaccaatcttcatgggctttttcgtcttcttctttgtcttcttgatctccgggatcggcctcctgcgcgaacgcagctccggcacccttgaccgactcctggccaccccggtccggcgcggcgaaatcgtcaccggctacatggtttcttacggggtagtcgcgatcgtgcaaaccctcttaattgtcatcaccacggtctggctcctaaaggtccaaatcgtcggtgacttggccctggtctttttaatcaacatcttgttggccctggcggcactagcaatgggaatctttatctccacctttgccagctcggaatttcaaatgatgcagttcgtgccgatcgtggtcatgccccaggtctttttctccggcatcgtgccgttggacgccttgccaaactggattcaggtcatctcaaaaatcctgccattaacctacgccggcaacgccatgaacgacgtgatcatgaaggggcaaggggttgaaacgatcgccggtgaccttggcgtcctggtcctcttcatcgtcttcttcgtggtcttaaacgtggcgggcttaaaacgttaccgcaaggtttaagaggtgtacaatagttttaaaaaaaggagaacgcccctatgccaactttttactgctactcccgttgttcgacttgcaagaaggcccaaaagtggctcgatgaccaccaggtcgcctatgaccaacaagacctggtcgcagaaccaccggccaaggaactcttcgttaagtggttaaccgagcaccaagacctgggcctgcgctacttctttaacaccagtggtcagcactaccgggaacaaaagctcaaggataagctaccaaccatgacgatcgacgaggccgccaccctgctgtcttcggacggtaagttaatcaaacggccgttgatggtcgagggctcgcaactgacctgcggctttaaagaagacgtttacgaacaaacctggcgctaaccagttaaccacccttttgcaagacaggacaaatctgcaaatttgcgcaggataacgtgctccccaaccgcaggcctagtggctaagcctggccgaagaacggtgctggcgcaccaaccgttcgccctatccttagcccacggcctaccagtggttggtccgcactcactttttattgcgcaaatctaaacatttatcctgtccagtccttcggtaatcaaacagcccctgaccaatggcaacccatcggtcaggggctgtttagttaacgcgagctacgatccgttaccccttcactctaagttaggcagcgggttgaagtagttaaccaacctgctttccagcgtatcgtttgtccgcacctctttgatcaccttattcagggtgctgacccggtcggtgatcaccccgtcggcgtggtcgaaaagggcctgcttcatcgccccggcattattgaccgtccacgccattaccagttggttcccttggtgggcggcgtcaatgaagcggtggtttaaggtcgaatactccgccgtcaccccgtccgcttccctagccgggttggtaaagttgtaagccatgcagtagagcaccgttagcttggggttgagccggtgcaacttagctacgtaagcataatcgagcgagtgaaccatgtccccatccttgatcaaacgggcgccgtaccgctggttaaaacgcgccaagaggcccttggaatcgtgcggggtcgccttaagttcaacgatcaggcgttggtggttttgctcggcagccgccaggtagtcatcaaaactcactagcttggcccggtagccatcctgtttggccaccaacttcgtcagttgcttaagggttagctggtggggcgccttgtcgaccccggtcagttgcttcaagttttcgtcgtggacgacgacaaactggtggtcggccgtttcgtggacgtccatttcgacaaagtctgggtgggccgcccggtgggtcttttttaacaccgcaattgaattgggcacgccgttttgcccgtcaacaccgcggtgagcgaccgtcaatggcgccgctaacttagttgttaagtaagtccagtcgctcggcatcgcggcgaagacaaacaccactaagattaagagccaccaggggcgccactggtggtaaccggaagccttttggggagtggctaccaagcccagggcggttgcgctaagggccaactccgccgccacctgggcaattaagagtccgctaagggccaaccaagtcggggcgttgccgtggttaaccaacaccaccaacccgttgacgagccaggaccacgccccccaccaaagggccaagcctagcgccctcttcacccgtccccaggacagccagcgcaccacgatgaacaagcaggctgcgtaaaccaacacgccgccaatcattaagcttggccgcctggttaggtaatcgaggataaaggcgtcggccttgatgttgaccagcaacggggtccgaaacaacagggtcgcaatcggcatcgccacgatcaacagcggcacccaggccaaggcaccccgccagcctaagttcaccacctgctggcggcaggccgctagccagccggcgaaggaaaagcgcccggccactaagagcctgagcccgctaaaggccaccaggacttggagacccagtaaggccaggaccacacacacctcgactagaagggcgcagacgattaacgggtgggtggtcaagagggtgacgacgttgtcaacggacacaaaggggatcgccgcttgtgccaataagaaagttgtcacgaggcgtaacagcggggtgagtagccaagttgccaccaggtctaatgaggcgaccaagccaaacccagccaggccaacgcgtcgaacggacattaggtttaatttcagggcttgcatcttttcttccttttctacttactgtcccccattgtaccaccccccaaaaaaggcggccgtagcggggggcatcgattgcgggagcataaaaaagcgcctaggagaaaacacgattttctcccgggcgcttattatctttctgaatgttaggcagccaacgtggtcaataaccgctggtgcactaacctgtaacctatccttagcccacggcctgcttgataggctggagcgcactccttaatagtcaacctcatccgggtcggcgcactggccgcccatgttcggtaaagcggcaatttggcccatctccgccggtgacagggtgaagtcaaagacgtccgcgttttccctcatccggtgttcgtgaaccgactttggtagcggcaggacttcttgttgtatctcccaacgcaaaaccacttgggccggggtcttaccgtgcgccgtagcaatttgcttgatcgtttcattctccattaccgtggctccctgaccacccaacggggcccaggcctcaaccaagattcccatcgcttggagcttcttaatctcttcttggtgggtccagccggggtgaacctcaatttggtcaacctgcgggcggatcttggcggtctttaacagctcggcaacgtggtggggcatgaagttagacagcccgatcgccttaaccttgcgctgcttgtagaggtcttctagcgcccgccaggtctcggcgttaagcgctgcggcctggtcaccaaactgcttttggttggccggccagtggatcaaatacaggtccaagtaggtcgtttgcaggcgcttgagggaggcttcaaaggcggcgatcgtcttatcgtagccccgctcggtattccaaagcttggaggtcaaaaagatgctgtcgcggtcaatcccggaatccttaatcccttggccgaccgcctcttcattttcgtaaacggcggccgtgtcgatatggcgatagccgacttcaatcgcggttttgaccgcttgccgggccacggtggccggggtccggaaggttccgtaaccaaccgccggaatggcgattccgttggcaagggtgtaggcactcgttaagtcctttaattccattatgcttcctcctttggttcgtgcgacgacggcggggcgctcagggttaccacccgcttggcccgggtgaagtaaaggtggcggtggatcttttctaggggaacccccgtcatcttggtcagggcatcggcgtacagcaccagttggcccgagtacttgtccgccagttcctggaggtcttcttccgggtgggcctgactgatccggtcggtcttgtaatcgaacaggtcgatctggtcgtcgtgttggacgtagccgtcgatgatcccgtggatcaacacctcactgtcatcggtggccccaatcccgctgaagagatcgtgggcgctcagtaacatcgagaacggtacttcccggtgaacctgctcagggtgggcggtaatgacctgaccgagccccgtttggtaaaaggataccacgccggccacgtcaatgcccgccgcaacttggggattatcgattaaaccactctccgttagggacttaattaaagcacggaccgccccttcgtcaagcggttccgttaacggtaatttctggaagaccaagtgggtagcggtcccgatcgccgtcccggttggctcctgatcgctcgccccggtgatgaaggcaggattttcgaaggcccgctcttccggtgctaggtaggccccggcttctttgatctggtcgcggtcaatttctagccgacccatctccaggttggtagggtcctggcgggcaaaggcctcccgcaccgtcgaaacggcttgaaaggcggtcgtttgggtcgccacttgatccgggtaggtaaagtttaacacccgttctaagtcggccttaaactggcggctagtggcggccgccggggtggcttgctccgccgtcgcattcgggtgcaggtccagcggggtgttgagggccgcctgaacctggtcagcgttttgcagcttaatttggtaggccgccttggtaaggccccgcagcggggtggcggcggcttcaaccccctcccttagcgttgggaagttcgccgtccgcaccagggtcatcatgatccaatcaagcatcgattgccccttcaagcgtgtggtggtggtcaacagcgggctggcgctatcaaaggcccggttccacttatccatcttcttggtcaggtcagcgtccttcacgtacccggtgatgaagaggcgctgctcggcccgggtcagggccacgtagaggaggcgcatttcttcggcccggtcctggcgcttctttttctcctttaaggccgcctgttggaccagcgggtgcttgacgcgcatcgtctcgttggccgtgctatccacgtaggtgaagccaagcccggcctggggctcaatcgttaccggatcccggtcggcttggaactggtgggtcgtttccactaagaagacgatcgggaactggagccccttggacttgtggatcgtcatgacgttaatcgcgtcaccggccagggccgtggtcgcctcgcccaagtcgtcgtttttcttttgcatctgctcgatgaagtggatgaactggtaaagtcccttgaagccactctcctcgtagccactcgcccgttcgtacagggcgtggaggttagcttggcgctgggggccgccgctcattccgcccacgtaatccaggtagccggttgcttggtaaatcgtccagatcaagtccaccagggggcgtcgctgggcgacccggcgtaagtggtcccgcaactcaaagaagcgggctaacttcaggtagattaacccacagttgacgcccagttcttccttagtcgctaagccggccgggtcgcctgcgacccgttcggcgagctcctcttcagtcaaggcgtcgtggttttcaaccgcttcgacctcttgatcgcgccaagcgtagtagttttgctgcacgacgccaaagaagtccttggaggtgctgttgaccttcaagtaggctaactccggttccgtaaagccaatccggttttcgccctggctcaggccgaacttagccgccacctcgggagcgacttgaatcagcggcgaacggagcacggccgccaacggaacgtcttggtaggggttatcgatcacctttagcaaggacatcacgacccggatctcggtggccttaaagtagttttccaccccgtgcaccatcaccggtaagttaagcttggcaaactgttcggcgatcaccgagtgaatccgcttggcccgcgacaaaatggcaatgtcgcccggcgtgatcgggcggacccgcttggtttccgggtccaagatcgtttccttggccaggagctcgcggatccgttggccaatcagccagacttcgctagcgaccttgtcttccggctgacggaccacgatgacgtcctcgccggtggggttagcggtcgttttcttgacgcccccatcaaagagcaggagttccggggtcgccgggctagcctggtcccggtcggccccccaatcggccttgggcttcaagctggccttatcatcgtagaccatctcacccagttgctggtccatcagctgttcgaaaatgaggttgaccaggtcggtaacctcgtggcgggagcggtaattgtcgctcaagtccagggcctcgctgctttgcccatccgcgctgaactgatcgtagtagtccttaaacagggtggggtcggcctggcggaagcggtagatcgactgcttcatgtccccgaccataaagcggtggttttgcccactcttgtgcaagaggcgtaacaggtcgtcttgcaggcggttggtgtcttggtactcgtcgatcatgatttccttgtagtggcgctgcaactcggcttggacttgggcggcggcttggcgcttggcccgcgcttcttcgtcactccaggtcacctttgggttgatgttttcgccggtcaagatggcgtaggcgtagtgctctaagtcggagaaatcgagcaggcggcggtcctgcttgatgatctggtagtggcaccggaagtcggtggccacccgggttaagatctcaattagggcgccagccttttgaccatacttaaccaggtccgcggcggactggaagaagtaggtatcgtggaggtcgcccagctgatcccgcaggccaccccgctgaacccccagttcgtctaagagttcgggatcgtcgtcatccttacgtttgcgcaacttaggtgcaaaattcttcttgttgagggtctgggccaggctgtcccagctgcctaacaaatggccctggtcatcaacggtcgtggctaatttagctaaatcttcttcaacctgctcggcaaaacgggccggccccacttcgccaagggccgcccactggtcccgcagttcctttagttgcgggcccacgaggggttccaagaggcgcttaaagaaggcgctttgccgcgggtccgccccttcttcgaactggtaaaggccacttaagccggccagccagtcgctcgggtgcggctgggcgtcggcctcggtgtccagcgcctgaacaacggactcgaggttccccgccccaaagttatcgattaactggtgcagcgcccccacttggtccggattggccacccagtcatcgagggtcacttgccaggcctgttcctttaggagctgctgttcggcgtcgtcaattaaccgaaactgggggtcgaggtcgatgacgtagtagtagcgcttaatcaactgctcgcaaaaggagtggatcgtgctgatgttggccagggccaagcgggccacctgggccttcatgtgttcgtcggtcgccccgaccaggcgccggcggatccggtcgcgcatgttcttagcggcgtcggtggtaaaggtcaccatcaggatgtcatcgatgttgggccgctcgctaggcttagcgtccttactcagtccggtttccatcagctggatcacccgctcaaccaaaacggcggtcttcccactccccgccgaggcggaaaccaaaatgtctttttgccggtcgttgatcgccggctcctgttccttacttggtgtgaaaaccatcttcccctattcctcctcttgttcaaactttgcttccacgtcggcgtcggtcagctcgatttccttgtagtcatccagggcctgatcgaagcgggaaacgtctaagaagtcgctaaaggccaggccggtctccgcggtggtgccgacttggcgccggtacggcctaatctcgttttggccctgcaggatctgaacggcggcttccttaatcagttcggcgttgtggtccatcaggcgcttcaaatcggttggtgagaccaggttggagcccgccttagcgctgaattgatcgtcggcactaaccttaaagcggctggtgtcttttttactcttctttttgatgcttaacagggtggcacccttttcaccaagcccgtgatcgagggcggccaagacggcgtcatcgttaatcgtgatcccctggtagaggtgctcttttagctcctcggcggtcccctccttgccggcgtcaacggtcgggacgtacaaacgcaggtacaggctccccagtagttgctcgcccgggttggccgcctgtaacgcgttgaggtaggccagcatttgcagggcctggccggcgtaggcgtcgaccaagtcaaacgccttgttgtaggacttgtaatcaaccaccagctggtaggtttgctcgcccagtttcaactcgtctaagcggtcaatccgcccccgcaggctgaccttggcgccctcaccgagccccgccccggtcaggtcaaaggttaacgctggtaactcggcggcttggctttccccggtccaatccgcctgcccaaaggccttttcaaccgccactggttgggcgtcggtctgggttgcttgcaggcacagggtcttggccatggtggtaatcaactgcttggccacctgtagttgcaagttgacccggctgttattggccgccaattcccgcaactcctcttgttggttcatggcctgctcaaaggcttggtcaatcaactcggcttggcgcccttggtgctcttctttaaccaagtcggccagctgcaggtccggttcgtcgatcacgctttggacaaagaaggccagggcgtcgtggtttaaggtcccggacttgtcgctggagacctctaattcgtcgcgcttcttcaggtgcaaaccgtaacgcaagaagtagtcgtacgggttttggtagaacttctccagctggctaatcgaagccgtcaactggttggtgacttggccctggcggttagtggtgtacaagcgggccgccagttccggttgcagtggcaccgcctcgtttttggcgtactggccatcccggatgtcgtttaaccgccccgtcaaaccctcgtcgtggcgggttagggccctggccacgtcccgccaggcactagtcagcttacggccggtgtccttactcaggcgctccacttcaatcaggttccccatcgtcacggccggcgccgccacaaaggaccacacgtcgtcttcgcttgcccgcgggttcggtcggtctggcaagtcggtggtcggggcgttgttttggtcatcccactggttgaagtgacgggccaagcccttcaggtacggggagagggttaactcactgtcgtcgctgctcatcaggggggcgctcatgtagaggcgctcggttaccgacagcatgctcaggtagtttaagaagggctcgttgttgatctggtcggtcccgctgatgggcaggaactggtcgtcgtttaagccccgcttcaaaagttcccggtcggggtcggataagagcccctcgctggccttgacttccggcatcacgtcatcggtcgcccccatgatgaagaggaccttgcgctggttgtcctggatcatcccgctttccgaaaccaacacttgatccaaagtcgacgggatttgggcgtagcgcccggcgttaaaaccggtgttcatgaggtcggcaaactcggccaccaactgtcccggctgctcggtcggggccacctggtcgccaaggatggttacgtactcgtccaagagggtgccaaaggtctgccaaatttgctgaacgtcgcgcagctgggttaactgcccgctttcttgggcttggtgggcccaggaataaagttggtgacggaccccttgatccaagaggaactggtagaacttggtggctaactcccgcccggtagtggccgtttgtaggtcggccagggccggggccaattcgtctttgatgtaatttttgacccagttaatctgggcgttttggcgcttgagcgcatcgctttctggttgttctccttccagtcgccacggccgctcgtcaaaccacgaccgcccccccttgccgaacttcaggcagtagttttcggtccggtagacggcggtcatgaaggtgttggggtttcgcttcgcacgcccctcctgttggagctcttccggcgtctcgggaaccaagaggccggtctttaacaactccatcacgtcggcttcttggtagtagtcctttaagaccttgaacaaggcggcggtgaaggtcgctagcggcgaggtcgccattgggcgttggttatcgttgaagaccggaatttggtggcggctaaagatcggttctagcatcgtttggtagccgtccaggtgcctcgtaaccactaaaaagtcccggtagcggtactgaccggtggcaacgagctggcgaattttggtggcgacccggttgagttcggccacccgggttggggcggtgaaaaagcctacttggtcggtcggggccggcaacctgtctggcagagcgaagcgtgcgtctgcttccatccactcttcgacccccaccaaggcgtcgctaacccgtcgttggttcggctgattcaaaacaatcgggtctaacacatccacgcccacctgctgagtggcgaggttcaataagtcctggtactgcttggccgagcggtaatagaggttgttttgactcggcaactcccgtccccggtaatcccggtcgaggatcaaagaaaccgtggtgtcggcagcccgttgaatcagggcgtcgacaatcaactgttcctgggcgctaaattcaccggcaaagcgatcaaggtaaacgtgggtcgttgataggtcggcggcttcgaggtggtttaagagcatcgctgaccggtccggcgccgtgacgtgggtcgtgaccgccgcctcaaagcgccggtaaatttcgtacaggacggtcatcttgtcggtaaagaccgtcgattgactggcccggccaccccccgcctgactagccagggcccgcttaataatcccggtttcctgatcgggcgccaggtcggccggttgaatattggcgttttgtagttccaccagctgcttggtcaccgccgtggcaaagccctggcgttcgctttcgccccgaaacatcttcaaaaggtcgggggattctgccttgagttcccgaatgatcttggcgaccaccatcgccatccccacgttggaaaggcggggcttttggtaatcggggtcgtccttacacaaaaaccaccccaagcgcgaaaaggacaggaccgccacgttagcctgggcgtaattaccggtttgcttcaaccgctttttaagcccctttaaaacggctacttcggtggtgaacttaacgtggttgggcactaagtaaaggtaggtatcattgggtgcttgctggtactgagccgccaagcgatcgagcatcacttgctggtggtcaaaggacgcactccccaaaacaaattgtaaggtcgccatttttatcattcccccattcagatcgttgcctaattataccacgctagggtgccaaaaaggggaatgaatgttcgcattgttgtgcggacgaccgattgtgaatttatattcaatcacattcacctcgtactatcttttcatcttaatatcgttcaagttgctcacttaccaagttttttccttgtttttttagacagaccatggttaaatgaaattgttacttagtgaacttattaagtgctaagtaaatccatctcggcggtttagtgcgtcaattttcaaatctctcaatctttctattatgagtttgctcctcataggtgctaaaccgcgtggttacctaaaaaatacctccccgaaacagggaggcatttttagttatccaacctagtggctaagtctgaccacagaacaccgctggcgcgctaacctgtggtctttccttagcccacggcctgctttaatggttgaggcacacttccctataaaatcggcgacaacaaccgcgagaaggtctgcttaaaacgtaggcccagtggttgggcatcaaacatctccggggtaatcacccggctgtcacggacgtcgttaatgaagatttgttctagctcatcaactaactgccggtcgtacaagaaggcgttgatctcaaagttgagctgaaaggaccggaagtcgaggttggccgaccccaccgacgccatcttgccgtcgatcgtcattgtcttggcgtgcaagaagcccaactggtaagaataaatcgtcaccccttcgttggctagggcgcgggcgtaatactgggtggcccggtaaacaaaggcgtggtcgggcatcgaagggatcatgatccggacgtccaccccggagtgggcggcaatccgcagggcgtcgatcaccgaatcatcgggaatcaggtagggcgtctggatccaaatatggtcctgggcggcgttgattaggcgcaagtagccgagcttgatggcctgcaggggggcatccggccccgacgagacaatctgcatcgccgtttttcccttgttgagggcggccgaaggaaagtagtccttaaagtgggtcaagcgctcggccggcttgaccgaggcgttccagtcacgcaagaagcactgctggaggctgtaaaccccgcccccttgaatccttaggtgggtgtcgcgccacgggccgaatttctttagccggcctaggtactgatcaccgacgttaaagccccccacgtaaccaatctggccatcaatgacgacgatcttacggtggtcgcggtagtttaaccgaaagtctaagaaattagagtgggtcatcaaaaagggactggcaaagccgccgtttttacgtaggttatcgtaaaagctcttcttcacccccattgagccccaagaatcgtacagcacccgcacctctacacccgcggccgccttttgttccaagagggtccgcaggcggttgccaatttggtcgttgtagatggtgtaaaactcaatgtggatgctttgtttggcttgctcaatatcggttagtaaccggttaaaaaaggtaatcccggtggtgaagatttccacctggttgtcctcgctcaaaaaggactcatcaatgctttgaaagagcatgatcgttcgccggtaggtttgcaccaggctgtcctcggggcggggcatctccacaaaggcggtccgctgttcttcaaaggcgtcgtataggtgttgggcggttggcgaactaatccgttccaggcgtttttggggtaatttccggcccaaaaaggcgtaaatgataaagccgatcaccggaatcattagcaccattagccaggcccaagtagcggcgatgtcccgtttttcccggaaaacggtcaccagggccgccacttcgttgatgatcacgatcaccaaaagcgcccacctaatcaggtcccacgttaaacccatcaccaacacccccaaacgttatgaatatctttattttaacgtagtggacccggagaaccaagaaattcacttcactgaccaaaaaaagagactggaaaactttttccagtctctttttacagctattcaaatgttaggcctagccttagcccacggcctgccaaatagttggtccgcacttacttttaacgtgctcccaaccacaggcctagtggctaagtacggtcggagaacgatgcgtgccgtatcaacccccgtcctagcttagcccaacgggctgtcgagaaggttgatccgcacttactttgcttgttcaatcacgacttggccgtcctttaaggtggccacgaggtgcttttcgtccaggtggtcgaggtagtaatccgtcaccttgtcacggatctcttgttccaccacccgccgcagtggccgggcccccatcgtcttgtcatagcccttgtcaatcaggtagttcttcacttcatcggtcaccgtgacgtccatccccttcttggccaaggtttcgttaaccccggctaacatcaggtcgacgatttgctttaagtcgtccttggtcagggtgtggaattccacgattgcgtcaaaccggttcaggaattctggccggaagtacggttgcaacttgtccatcaacttagcgtcctcgcccgccacggcgtcgctactgaagccggcgttagaggtggcgatgatgatggtgttcttgaagtccaccgtgttcccttgcccatcggttaggcgcccatcatctaagacttgcaagagcaaggtgatgacttgcgggttggccttttcgatttcgtcgagcaagacgatcgagtacgggtgacgccttaccttttcggtcagggtgttggagttatcgtcgtaacccacgtagccagcggtggtcccgatcaacttggaaaccgccgtccggtcggtgtattcggacatgtcgagccggatgatgtcgttggtggaaccaaacatatcgagggctagttgcttagccaattcggtcttaccgaccccggttgggccgacgaaaaggaagctcccaattggccggttaccttcatcaaagccggcccggttacgccggatcgcccggctcacggcttcgacggcctcttgttggccgataaccttgccttccaaacgggtggctaagccctttaagcgttcgatatcggaagcacccatcttggacaccgggatcccggtcatccgttcaacggcggcggccacgtcactcggcgttgccacgacccgttcggattcggagtggtccttgagttggtcttgcaacttggccacctggtccttggcctcttgggcggcttggtaatcctctttttcaaccgcttcttgttgcttggcctcggcctttttgatctcctcttcaatcgtcttggcgtccttgaccgggtgcttggaggccaggtgagcggccgtgacgtcaatcaagtcgatcgccttgtcaggtaaggagcgttgcggaatgtattgaaccgagtaatcgatggcggcctttaagacgtcgtcgggcaaggaaacgttgtggtgcttttcgtacagcttacgcaaaccttgcaggatcttgaaagtgtcttccttgctcggggcgttaaccgttacttggttgaaccgccgagataaagcggcgtcctttaaaatcgtgttacggtactcgtcttgggtggtggccccgattaaggtcacttcaccgcgggaaagggccggctttaagatatcggccatccccttggaacccgaggcgtcgccggcgtttccggccccgatgatttggtgaatttcatcgaagaagaggatcacgttgccgtcctttttgacctcgtcgatcagcttttgcatgttctcttcaaaggagccccggtattgggtcccggcctccaagctggaaatgtcaatcgaaataatctgcttgttcttgatggcagcgggaacgtcgccggccacgatggcttgggctaggccctccaccaccgccgtcttgccgaccccggcgtcaccgactaacactgggttgttcttggtccgccgtgacagaatctcggcggtttcttgaatctccttgttacggccgatcaccgggtcgagcttgccttccttggcttcttgcgtcaagttgcggccgagcttagctagcatgctgtctggttgtggttgcttagtttttgcttgggttgggtcagttgcacccgggagcttcccggtctggcgaaaggcggcgtactcttcaggcgttacttcgcgcccgttaatcaggtaacggcggttgtcgctgttgaacccgttcattccccccatgagttggttaaataagtcgtccatgtcgttgttaaatggatctactggaattcgtgccataatgcaatcccccttgattgtcatttaaagtgagcgtgtagaaaagggcccatgttaaacaccgttaaacaccgttaaacaccgaccctgagactacacgtattctaatcatcatcgaataaatactgctcctccaattcccggaggacctgccacatctgcttatgctgggcctgggcaatcgcgtccaggtcgcgcaagttgagcgaagtagctttggtttgctgcttgttaaacgacttgtgtaaagtggtgtagccgtatccggaatctttagccacccggtaaatggtcaggtggttattatcgaggtaagccttgatatcgatccgcatggtcctcacttcctttacgattcttagtataccacttttacgatataacacaagtgtgaaacatacatttttcccaaaagtttttcttgactttaattagagaaagattagaatatgggtaacttattttaacaagggggttcaccaatgcgctcagccacgacacaacgaaacgcttatctggcttggttctttttcgcttcggcctaggaaccagctttcgttgtggtggtttctaggaagcactcccggaaaccacgcgcggtgacccgtcaaatgggaacaaagcgcccgggagttttcccgggcgctttttgtttccccgtcttcagaaaggaagtcttacccatgccgaagatgaacccagccctccgtggtcgctttaatcatgatttaaccagcatcgccccttccaacatccggacctttgacgcggaagtctcgtcaatcaaaggaattgtcaaactgaccttgggggagccggacttcaacgttccgaccgccctcaaaaacgccgccattcaggcaattgaaggtaacgactcccactacacacccagcgtgggaacggcggtgttgcgcgaggcaatcgcccacttcctttccgatcgctacgacctaacttacgaccccgccaccgaaattgcggtcacggtcggggcgaccgaggcgatcttcgccagcttcgaggcgcttttaaaccccggtgacaaggtcatcattccgaccccgaccttcccgctttacgagacggtggtccaaatgctcggtgccaccccggtcctggttgacaccagcgccaccgacttcgtcctcaccccggccctgttagaggagacgctcgtaaaagaggggccggtcaaagccctgctcttaaactacccgtccaatccaaccggggtcacttacgacgccgcacaactccaggacctagcggcggttatcgaaccgaccgacctcttcgtgatcgccgatgaaatctactccgaattgatttacagcggtcaccacgcctccattgccacctacctaccgggccaaaccctggtcttaaacggggcctccaagtcccacgccatgactggttaccgaatcggcttcgtggccgggccggcggagctaatgaaggtcgtttcgatggtgcactcaatgctagtaacctccccgtccaacccggccatggccgccgccgtgccggccttcggttctgaagaggggcgccaggctactttaaccatgaaacaagcctaccaagaacggcgtgacttcatgctccaagctttaagccaagccggttttaaggttgccagccccaacggcgccttttacctcttcgctaagctaccaactaagtttggccaagacgacgaggcctttgccaccgccctcgctaaggaaggggcggtcgccgtcatccccggttccttctttggccccggtggtgaaggctacctacgcctctcatacgccaccagcatggacaacctgaagctcgccgccagccgtatccaagactttgtcgccagccactaaaaaggagagaccaagatgactaagattttaatgaccagcgttcgtgacgacgaacaagccgccatccaagactacgccactagaaaccaagttgagatcgttactagcccccagcccatcgaagaggtactagagctaaccgcagacgtagacggggtggtcatccaacagcgcaacccactgggcaaggaagtctacccgaccctcaaggccaacgggctcaagcaaatcgccacccgaacggccggctacgacatggtggacctcgcggctgccaagcaaaatggcctgaaggtgaccaacgtgcccgcctactccccccgctcggtggctgaacacgccctgatgcagatcttccgcctcttacgtaagacccccgaggttgaccgccgggtcgccgaaaacgactaccgttggccgggactgcaagccaaggaaatccactcggtaacagtcggcatcatcggggtcggccgaattggggggaccctcgccaccctcttacacgccctaaacgcccgcgtactcggttacgacctcaagccccgcgaggaaatggaagggattgtcgaatatgtttctaaagaggaactcctccggcaaagtgacgtcgtttccctccacgtggatttgaacccaacttctgagggtctcttaaccaaggccgagtttgaccaaatgaagccgggcgctagcctagtcaacgccagccggggaccggtcgtcaacaccgccgacctaattaacgccttaaaggacagtccgctcgcctttgccgccctggacaccgtggagggtgaagggccaatctttaacgccgaccaccgccaggacggcctgaagggtgagccactagttgaggagctccacgccatggacaacgtgattttgaccccgcacatcgcctttttcactaacattgccgtccaaaacatggttgacatctccttagatgatgtcattacgatcctaaatgggcaaccatcggaacatgaagtagcgaactaggaagtgcgacccaaccatcaaagcaggccgttgggcgccatattatatctaaaataaggccgggaaataactccgtgtttcccggccttttaatgtattcacgaattttagacagaaaacctggtaaataaccgcaggcctagtgtctaagtacgggcgaagaacggtgcgttccgtaccaaccgttcgccctagcttagtcatacggcctgccgagtaggttatttaccactctgttttgcttgcctttccccacctcagggcgttaaataaccttattaataaataaggggatagtatcaatgcaacaagcaaagaaacgacggctcttagctagcgtggccgccgggacgctcggcctttcctacctgacggccgagtacctctttaacttcgccttcaaacgggtcgattacgtaccggaaacctcggcggacaagcaaaagtacgccgcccagtactggcgctacgttgactggttcaaaaaggttgaaaaagagcactggacctggtcgaccgatgacggcgacgaccagatgtcggcctacttcatcccggctgacgacagtaccaaggcagtcatcatttcccacggttacaagggcaacggcgaaacgatggcgaattatgctaagatgtttcacgagctgggctttaacgtcttattacccgacgaccgcggccacggtcaatccgctggcaagtacatctcctttggctggctcgaccggctcgattacctgacctggctaaaccggctcattaaacggctcggcgcccaaactaagctcctcttattcggggtctcaatgggcggggcgacggtcgagatgctgagcggtgaagacttgccgccccaggtcaaagcgatcattgccgactgcggctacgcctcgattcacgaagagctgacctacctgctcaagcgtcagttccacctacccgagtacccgatctacccgctggtgtcgacgatcaaccgccaccggctcggctactacctaggtgacatctcctcgaccgaccagctcaagaaaaaccaccggccgatcttctttatccacggcgaaaaggacacctacgtcccggccagcatggcgctggaaaattaccaggccaccgacgcccccaaggaactctggatcgtcgaccacgctagccacgccgagagcttttggcttgacccaacggcctaccgcgcccacatccaggccttcttgaacaagtatttttactaaatccggcgccgcccttataatattagtaaacgcttgcaggaaggtgagattagtatgtgcacgagcatcaacgtcattacccaggacggctaccacgtcttggggcggacaatggactgggacgacctcttagtgtcgcccatcttcaccccccgtcactaccagtgggcctcggtctttgaccaccgggtccacgaaaatccctacgccatcattggtggtggctcgatcaccgagcggcgaaccgacgtttccgacggggtcaacgagtttggcttgatggcccaaaagctgacctttaaaaacggcgcccgcctggttgacgagcgtcaccccgacaaggtccaactggccgcctttgagctaatcttttacttgctaggccactttaaatcggtggctgacgtcgcggcgcacctggatcaaatcgaactaatgagcgacgtcaacgccgacgtgccctttggctactccgagcaacactttgtcttgtccgaccccaccgggcgttgcgtggtcattgaacccagcgagcacccgctcaagctgatcgataacccgctcgggatcatgaccaacatgcccaagttcgaccaccagctggaacgcctgcaggactacctagacttcaccccggattttttgaacggtaccctggcgccgaacacctttcacgtcaccaccggtaagctctcgggcaagaagacgccacccggtgcctacacccccaaggggcgctacgtccgggccgcctacataaaagaactggccgaccaaccggcatcaaaagacgaggcgctggccaccacctggcacctgctcgattcggtcaccgtccccaagagcaaggcccaccggccaaccttctcggtgtaccgggctgccaccgttgctgaggaccgcacctactacttccagtcctaccaccaggcccaggtgacctcggtaaagctgactgacgacttgttaaagcgagccaccccgctcgtctttgacaccgccgacgtttgggcgccggtgaaattgaactaactaatcgaatgtagagacccagagaaaacatctttccccgagcctcttttttgatcagttacattagcatcgttggcgctgaactcggtaccgaaaaggggaaccacttaatcgaaggcctgctagccgccatccccgcgaaaaagcactataccggtaagatgctggggatctgctttttaattgccttccagctagtgttatacgccgttttcggcctcgtcggcttcctcttgttacgccactccaccttcgttaagtccctacacctcaacgattacctggctaaaattgatccccagtacctgtggatttctttgattctggcactcctttcgttgttcctctacatttcactggcggcctacctagtttccttggtttcgcgcgccgaagacattggccaagcgacctccggggtgaccagcatcctgttgatcccctacttcatcaatttcttaacccaaagtaaccccaacctactcgtcgttaagatcctatcctacctgccgtttatgagccaagatatcatgccagttcgcatggcccaaggtgctgcttcgtattcggccggttacgtagcggtggccatttccctcctgagcgccgtcttgatgtacctcttcgctcaacgcacctacgtcaacaacatcttcacttaccgctcggagacacccctcaaatacttaactaacaagctactgcgccgcaactaaatggggctagcagacgaataaaagccaaccacttcgcaattgatcatgcaaagtggttggcttttttcgtaagatcaggcttttaactcaaccgttccttcagcttagccaagctaacctggtcggtacgatcaaagcgggccgccgcttccttgaggtcgctggccggtccaattccgatcgacagctcgccggccgcgttaatggcggcaaccccggcctgggcgtcttccacgccggcaacctgggcgggggcaaggtctaacatctcggcggcggccaaatagatatcgggcgccggcttgccgtgggcgacgctagcggggtcgaccaccccttcaaagacgtcttctaactgcaggtacttgaggaccgtcggcgcgttcttggaagccgaagctaagaccagccggtagccggcggcctggagttcggctaagaaggccggcatccccggcagggcgtctgacggcgtcaaggtcttgaccagctcttggtagcggtcgttcttgctggtggccagggcgaccttttcttcctggctgtactcaccctggtggccgcctgcctttaggatcagctccaaggaatccatccggccaactcccttgaggctcgcctccagttccggcgtccagggcgtctggacctggtcggccagttcttgccaggcctgggtgtgaaagcgggcggtgtcggcgatcaccccgtctaagtcaaaggcaaagccggcaatatctgtaaagttcatggcgaaaatctcctttgttcgtggttactttcattgtacgggcgccggtcaagtgatttcctggaaaatagccacttcggaggccttaaagtccggtttattggccttccccccggtaaattcctgggaaaaaaggaggggcgccgctactttaattcggttaattggtcacccaattcgacttttaacggttccccgctcagcagttgcaagtgggtgccgtcagcgtccacccgtacctgaatcgtgcggccacggaagacctggttgaattggtaggccgtccagttcttcggtaagaacggggcgtaatgcaagcgcccgtctctaatccgcatcccggcaaagccctggacaatgtccaaccaggctccggtcatcgaggtgatgtgtaaaccgtcgtcggtgtcgttgttgtaattatccaggtccagccgcgccgagcgttggtaaagctcaacggccttatcctcgtcgcccaggtcggcggccacgatcgagtaaaccgacggcgacaggctcgattcgtgcaccgtgaactgctcgtaaaagtcgaagtttttccgcttttgttccggcgtaaagtcgtcgataaagtcccagatcccctggatgacgtccccttgcttgacgtaaggtgagcgcaggatcttatcccaagaccagtgttggttgagcggcagctggtcgctagggatttgggcaaccggcaccaaatccttgtccaagaaggcgtcgttttccgggaagatccccttgtcggcgtcctctggcaggtacatgttgtcggcgatcgccttaaagagccgccgttcgtcttcggtcaccgccaggtcctttaagacgtcctcatcgacttggtccaagatttccagggtgtattggaggctccactggcacaagaggttggtgtaccagtcgttgttaacgttgttgtcgtactcgttgggcccggtcaccccgtggagtaggtacttgttcttgcgctgggagtagtggacccggtcggcccaaaagcgcgccgtttcaaccaggaccttggccccttcgtgcaagacgtaggaggtatcgccggtgtagcgggtgtagttataaatggcgtaggcaatatcgccgttacggtgaagttcttcaaaggtgatctcccactcgttgtggcactcgatcccgttgaaggtcaccatcgggaacagggccccctttaacccctgctccttggcgttaacgtaagcgcccggtagctggtggtaacggtagtacaagaggttcttggcgacttgcgggtcggccaccccaaggtagaccggcaggcagtacgcctcggtgtcccagtaagtggccccgccgtacttttcgccggtgaagccctttggcgagatgtttaagcggctgtcgttgccgtagtaggttgagaaaagctggaagaggttgaagcggatcccctgttgggcctcgtcatcgccttcgatcaccacgtcggacttggcccagcgctgggcccattgactgacgtgggcggccaacaggtcgtcgtagctaacctggtcgacttgggaaactaagtcctgggccgccgccaccagttccgcttggtcggcatagtctcgtgaggtggtcacgatcgtccgcttttccagggtgacgctttgcccagcggccacgtggccggcgaagtggttagcaacctgcttagcttccacggcgtcgccaacgtggggaaggtcggtcttgacactggtttgcatggcaaccgtaaactgcggggtgccaaagtcgtttgccttggtttgggaaaccagcagggcgcccttaccgcttgcttttcggtctaggacttgccagaactgttcgtcgtagttggcgtcttggttgtaaacgtcggcgtcgatttgagcgctgatcgccaggtcgatttcagcagggctttgcaccgtcaaccgttggcccaccaattccttttggaccgccgagacaaagcgttcaaactttagggtgaccggggcgccgccaaccgtggccgtcaccgtccgggttagggtgccccgccgcatgtcgaggtccaagttaaagtcggttggggtttgcttggcaaagtcgacttgttcgccgttaactgcaatcgtcagcttcatgaagttgacggcgttgatcatcttgccaaagtacttggggtagccgtttttccaccagccgacccgggtcttgtccggaaaccagaccccacctaggtaaacgccttgcaaggtcgtatcggaatagccttcttcaaaaaagccccgcatccccaggttttcgttggccagggcggttatcgattcttgcagtaacttgtcttctggtgcccacttggtcgtcttaacgtgccaagggctaacttcaaaggttcgtttcatggttgattctccttatttgacgtaggtttctttgatcgtggtgacggacagcgccccgagcaacatcacaattccggctaagaggaacatattaacttgagagccgcccaacattgggaagagggcaaaggaggccagggaggccacgatttgcggcaggcagatcgagccgttgaacagccccaggtaagtccccatgtgcttcccggtcagggcgttggtcacgatcgtcaacgggtaggtgttcatcccggcccaggcaattccgaccagggcgtaagaaaggatcaagacgtactggttgtgaacgaagaaaattgaggcgaacccggtggccccaatcaagaggctgcccccgtagccgagcttgtgatattggttcggcaccttggctaagacgtaggaccaaaccacggcggcgattgattggacggcggctaaaaccccgtaccagttcccggccgcttggtaggcggcggaagtagcgttggtggtgtgccaaacgttttgggcgattgcccccgccgagtaggtccacaggtattggaaggcaaaccagcagaagaattgcactaaggtcacggtccaaaaggcctttggggcgtgctttaatagtgttaaccagctttcacccttttggttatcggcctcttcaatcccgtggtacagggcgtaagtggccgggtcatattccttaaccttgagcatcgtaaataaactagtaatgactaacagggcggcgccgacataaaaggccaccacgacggattggggaacgacccccttcttggccgtgttagcgacccctaagaaggtgaagaggaaggggaagatggcggctaagacggccccggtgttggataagaaactctgaatcccgtaagcgtaggacttttggtcgtcgttaaccatgtcaccgaccatcatcttgaacggttgcatggccacgtttgaggacaggtccaaaaaggcgaccgtgattgccccgaaccacagggcggctagcgagccgtaaccaaagccaaaactccccgagttaggcaagaggatcatcacgatcacggcgacaatcgtccccaataagaggtaaggcaggcgccggccccccagtttaggcgcccaggtccggtccgagtaggccccgacgatcggctgaacgatcaaacccgccagtggtggtaagaggaagaaccagcccaggttattcgggtcagccccaatcgtttgaaagatccggctcatttgggaactttgcagggtaaaggcggtttgcacgcccaaaaaaccgaagttgatcatccagatcatgctcttgggcagggttggcaaaccagttgttgtcttttgcgaactcattttctccactccaatctgcttgtctcctcctttgggtggatccctccccaaagaaagcgatttatcttttcgtcaggagtaaatatagcagactattttcttttatgcaaccgtttgcacaaaatttgcacaaaaaaatggaagtgcgccccaacctcctcgacgggccgttgggctaagctaggacgggggttgatgcggtacgcatcgttctccggccgtacttagccactaggcccgtggttggggagcacgttattggaagtgcgacccaccgcggaaatttaagaaatacctagatcacaaaaagcccggactagagcaatcaatcacgattgccttagtccgggattcatttaagtaggctgattgccccctactacagggcaaaggaaataaattggtggtcggcttggcggttgaagagtagctccacggcggcgatccccaactgacgagggcgcagatctacccggtcaatcgcgggtaagagccggcccagcaaccggctattgttaaagcaaatgatcgctaattggtcttggcgccccaaggcttctagttggcggtagatctgcaggaacaagatgtcgtcggcacagaccagcccgtcaatttccgggtgttgggcaaaaaattgtggggcgttgtcttcttcaaccacccactcggttccacccaggccgcgttcgttgaggcactggcggcaccctaaccggcggtcgacttcaaaggtccagtggtgcggcgaggtaacgaaagccacgtgctgacagtggtggtcgtccagcagcttttgggtcgctaaaaaaccggcctgaatgttgtcgttgtcgacgaagcgatcacccttcttttctgggtgaccgatgacgacaaagttcattccggcgtcccggaggtagtcggtgaccgggtccttttccttggtgtacagtaacaagaagttgtgcactttggattgggtgaccatcgacttgaccgtttctaacagccgttcttcggtttcggtaatcgccaccatcatcgtgtagtggcgctgctctaaagccaccccggccccgcgcatcaaatcgatgtgaaaggggttagccagggcgctttggtcggtcaccggaaagaccaacccgaccatgttggcctctccccgggtcaacgtttgggcgttgtagttgggggagtagcccagttccgccgcgatctgcttgaccttggttcgggtcgcttcgctaatgcgggggttgtcgtttagggcgcgtgaagccgtcgaaatcgacacccccgctaacttcgcaatatctttgatcgtcgccatcgctactatccctcaattcgctcttgcaagttagcggtgatttccgccagggtaatctcttgcatcgccgcctcggccgccgcttggaccttggcaaactcctgggttaagaccccctggatgtttttaccaatcggacaatccgggttggtttgttcatcgatgtgcaggaggtgatactggtcttccaccgcccggtaaacgtcaagcagggtaatttcttccggctccttagccagggctggtgaagccgtcccaggatgggtgacgagcaggccggccttggtcaggcgcgacatcaaccgtcgcaccaaactagggttggaatcaatactgctggcgagccgggctgacgagattttggtgtcttggtgtaagtaaacgtaactaaggacgtgaaccccatcactaacgcggtgcgagtacttcatcatcatccatcctttccgtagaataattgttacaatgataccattttctaattagaggacgcaaaagggacgccggtgggggcgtcccaactaacttaattatatactactcaaccggttggcggattaatcaggcgctaagtttttcaaaattacttatccttttccttccgccacgtagtttaggaactttttcattaaccgctcggcgcccctacttatggtagggcaggccattaatgatcgtgaaggcccggtagatttgctcggctaagaccaagcgcatcaacttatggggcaaagtaaaacgcccaaaggaaatctgggtgttggcccgttttaaaacggccggactaagccccaaggaaccgccgatcacaaaggttatattggagtggccataagtggccagctggttgatttccttggcgaactcctctgaggaacgttccttgcccttaatcgccagggcataaacgtattcccggtccttgatcttcgccaggatccgctcaccctcctttgccatcacggcgtccatttcggcctgactgagggtctcgggggccttttcgtctggtacctcgacaatttcaaacttggcgtagcgccccatccgcttggcgtactcggcgatcccggccttaaagtacttttccttgaccttgccgaccccgataatcttaatgttcattttttctcctctccggacttttccccacccgctcaaattagcgggggaaaagccgctctttcatgttcagcgactatatccaccgttaaagttcagttttccccagcttttcaacaagtcatccccaacttatccaccgtttcttggggataagtcgcggtacccccctgtgaataagtggttatttgcatgacttttccacattgtccacagaaacgattgttcgttccgtcatccaccaaccccttgccccgcttgcatttacggcgttcggtttcctcactcgtccacttttccaccggttatccaccatcctgtggataagtttgtgaaatgatcgtttccttactgccccggggctttgctctcttgtggaaaactttttggaccgggctaattttttctcgtttcgctacttcccttcggtttcgcttcgttcacgaacacttagcaacggaaaggaccctaacgcccgtaattcacgaacgctagggtccccctactcagttactcggcgctggttgcgtcatcactagaagaactgctggtcgtggtcgacgagctagcctccttgtttaattctaccttggccgttttcttgcttccgtcacggtagtaggtcaaagtgaccgtgtcgccgaccttgtacttgtagagcaccgtctttaagtcaccggcatcggtaaccttcttgccgttaatggcggtaatcacatcgtattgttgtaagccggtgttggcggcggggtagccactttccaccttcatcaccaccacccccttggttacgctggttggcaggtttaagaccgactgctgttgactactagaaacgtcggacaggtccaagagtgacacccctagcattggccgggtgatcttgccgtttttgattaactggttgatgacccggaccacttcgttactcgggatggaaaagcccatcccctccaccgaggtcccatcggtgctggaggctagcttcatcgagttgatcccgatcacctggccggccatgttgaccagtggcccccccgagttaccggagttaatggcggcgtcggtttggataacggtcgtggccaccgagctgtcgctggccttgaccgtccgcttggtggcggaaatgatccccttggtaaccgtgttggcgtactcggaacccatcggtgacccaattgcgatcacgtcctggccggccgcaatgtcgttagagttgccaaaggtggccaccgtcgttacgttggcggcgttaatcttcaagacggccaggtcggtcgtttcatcggtcccgacgatttgggcgtcgacggtcttgccattactcaagataacttggatttcactggagccggagacgacgtggttgttagtaacaacgtaggcaacgttgccgctcttcttgtagatcaccccggagccctcgctagccgtttctaagctgccagaactggagctagttgacccgtcggtgacgttgccgtacaaggagtcactgctagacgtggcctgcttattgataaccgagaccaccgcgttcttagtggcgttataggccttagtggtttcgttggtcaggctggccttattcttggaaaccgaggtgccgccgctcttggacgagcccgcgggcaccttcgtggtggcgtagttacggtaggtactgatggcggagttaatcccgagggccgcccccccaccaaggagaccggccaagacgccgacgaggatgaccttcccccaaaaacggcgctgctgtggtgctaagtgcttcttcatcgtttttcccccgatcctttttccctaagggtagcaaacatttacgaatattctattaatcagctactaactttttatagactcaagagcgggctgggttgatcgggctccgcgtccgccaacttaaagtcgtggtcgacaccgaaatcgtggttttccaagatgctagccacggtcaggtgcgccagggaccgcatgttgttgtgctggctgcggtggcccaaaaagacccgcttggtccgctcgccgatcacttccattagggccccggccccctcttcattggataagtggccggtgtcgcctaggatccgttgcttaagcggccatgaatagggccccatccgtagcatttccgggtcgtggttgcactctatcaagtagccatcggcgtttttgatcgtctgaacgacccggtcggaaacgtaaccggtgtcggtcaggatcacaaaggattggtcgtcgtggtgaatttggtaaaactggggctgcgcggcgtcgtgggagacggcaaaggcctcgacttgcagatcgcccaggtctaagaacttacccggcgccaggagttgcttttggtctggagcgatcttaccgatcttgccctccacggccgcccaggtacccgcgttggcgtataccggcattccataacggcgcgccaagacccccaccccatggctgtggtcgctgtgttcgtgggttacaaacagcgcctcgacctggtctaaggaccgcccgatcgcttccatccgctgttccagctgcttaccggacaagcccgcgtcaatcaagatccggtgacccgccgtttccaagtaggtcgcattgccccccgatccggaggctaagatgctgtaatgaattgtatctgccactgttgcttgcaccactcttcgttcccttcttaattgttttcctgaattatcgtgccactaaaggcgttgatccgcaagttttgtgttgtcgtggcgctcttggcccgcaactgaacctggtaaatcggcacgaagatctgcttaccattactagtcatcagcgggctgtagccgtaggtcacccggacaatctgcgtactgttaggaatttcgttgtggcggtacaaccaggtgaccgcccggacctgactgatcgtcccggactggggccgcaaaacacgctcctcttttaagtagccctgggtgtaaccgaccaccttagtcctagcggcgttgagccggagccggatttgcccctcgtggcttaacaccggttcacccttaattacctgggtaaagacgatgctgtggctagtcgacaaagcggcgctgtattgatagctagtcccgtgcaagaataggtgcgaatccttcagtagcttctttagttgcttggggactgactgggaagaagataggtctaaggcgtcgacaaagttagcggtcaacaggttcccatcggtccgggtggtttggtttttcaaccgcccccgctccgttgaaaggtccccgggggtcaccgctaagtagtaccccgtttgggagttggggctcaacttggggtaggtaatcgaattggacttcatttcctttagggttagctgggtctggctctgttgcttgccgctggtggaaaagttctcgttgccccataagagggttgaaacgagtaccaggtccaagatgataaaggcgattaaaaagatccactgaattctgcgaaagttcatcttaatccccctttaacaggctttgatacttgacccagttaccgtggtagtagacgtaataggttggcgaaagcgtgacgagcgacttattttggttggtcgcccaggtgtagcccagccgtaagcccttgatgtctttgccctttcccgcttggtacagggcgtttaaaaccgtgaccgtcgagggcaaggttaccttttggccactcgccggaagtggggtccccaggcttaacggcgagaggtggtagcgttcgaccccgtcgttattggccttaatccggaccgtcccgtagtcattgtcactaaagatcgggaaaccctcgacaaaggagcggtaggtaatcgtttgaccgaccaaggagacgttgtcgtattgaacttgttccagggggaccgcagtgtcggccaacaggtcaaacaggtgggtgtacaaagtctgggtgccgtaggaattatcctttcccaggtagttgtcgtattgaacctggccggtgcccttattgtaagtcatccgccgcgaattaccggccgtgtaggtaattagcttactggtcgtttgcgaactgaccgtcgaaacgctagacgaggccatcagggtttgggctatgctgtccaagttttggtggttaatcgttgaacggtaggtgggcatgctgatctggtgggggaaggtggtcaaaggaatcccgttgacgatcttgtggtcaacgtttaactggctcccccccaccagggactttttgatcaccgcaagcgattgactggtcgtcgtcagccggtagacctggtacttttcgtcggccatcaagtaaacggtcggcgtcttatccagggtaatgacgatgtggttgatccgcttgagccgggccgtatcgacactctggttaaaggtctggttaaagaccgtggtggctacggcatcggggtaggagatcatgattgagttttcggtgcgtaggtcccgcaagtaggccgccgaatcgttgttaacgacccgggtaaggtgctttaacttccacttgcggacctgttgttcaatcaccatgaccgggtttttagcctggtcatagagaagcttttgcgaccggtcctggtaggtacggatcacctcggtgggcttataaatgtcactcagggattgaacggtgtcttggcgcgccgaggtactcgtgctgtccccgctgccccgctcgtagtggaagggattgatccagacgctggccgacaaaacggccgacagggccaccacaatcaccagggcaatcgtcaggctgctctttttaatctgcttgatcatcccattcctcctcttcgtatggtacgtatggcaaggaaatgtagaaggtggaccccttgccttcaaccgaatcaacccagatttggccgcctagcaggttaacgacttcctttgaaatcgccaagcccagcccggtaccgccctgctttctggagcgggccttatcaacccggaagaagcggtcaaagatgtggccgaggtcctttcttggaatccccagcccctggtcagaaatcgacaggatcacgtggttgtgggtctccaacaggcgggcggtaatgaccccgccgtccggtgagtacttaacggcgttgttcatgatgttatcgaccacctgggtaaacttatcggtgtcgatttcaacccacaggtcctttttggtgaagtaacggacaatcgtgtacttctttttgctcggatccgcggcctcgtttttgatgatcatgtcaaaacggttgagaatgtagttaaacagctcgttaatgttgacgtactccaagtttaacttagccgttcccgaatccatccgcgacaggctaaggaggtcgttaatcatccggatcatccgctcggtttcatccgataccacccctaagaagcggggggctaattctgggtcgttgatcgccccgtcactgagggcttccacataggacttgaccgaggtcagcggcgtccgtaattcatgggaaacgttggaaacgaactccttacgttcacgttcctctttttgctgggaggtcacgtcatgtaagacgcaaactagacccgagacaaagcccgattcccgcttaatcggcgagaagtaggccgataaaatcaggtcctcgtttaaatcatccaagataacctggtcttggtcttcgtcgactaggtggcgaatcgagaattggcgccgaatctttaagacgtccaaaatcgacttgccgagcacctgctcttcgtcagcgatgtttaaaaactggagggcggtgttattaacgatcgtcaggttaccccggcggtcggtagccaacaccccgtcagacatgtgggagaggactgaatccaaccggcgccgttcggcatccgaggactcttgggactcctccacccgcaccgagaggttgttgactgccccggccagttggcctagttcgtcgttgcccatcaccttaacctgcccggagaagtccccacgggcaatccgtagggtctgcttgcgcatttcttcaatcggccgggtaatttcccgggaaattaggaccgctaaccccagccccaggacaatcgtgatcaaagccgccgacaggtagatcaaggagatcgagttgatcgtcgaatagaccccctcgaggttggcccgcatgtaaacgaccccgaccacgttattggcgttgccactggctaacagcggcacgacactgacgtagtagcggttgtggttggcgctgtcgtagaggttttcggtgtgggagcggttgttgaccagggtgtttttaattaccgtgtcggtggtcttttgcccgacgatcccctggttgcccgaactactggtcccgcgaatgatccccttggcatcgaccacccggatctcggtgatactggtgttgttgacccgggcgaggatcgttttaatttccttgttggccgttttggtatcggtgctggtcagttgggtggccaaggaattgtcgatgtaagacggcaactcaatttgttgcttgaagttggcgagttcttggtgttccagttgacgcacaaaaaccgcccccaccacttcgagcgtcagcatcagcatcagcgcaaagacaagggcgattttaaagtggatcgactggtagaatttgattttactgttcacgattcaggcccttaatcctgattcgggttggccaggtagtaaccgaccccccgccgcgtgatcagccactgggggtgactcgggttatcttcgattttttcacgcaaccggcgcaccgttacgtcaacggtccggacgtcaccaaagtaatcgtagccccacaccgtttgcaagaggtgctcccggttgatgacctggccaatgtgttgggcgaggtagtgcaagagctcgaactcccggtgggtcaggttgatgttttcgccccgcttggtgaccgtgtaggcgtccgggtggatggtcaaatcccccaccttgatatcggcggtccggtcgtcgttcgccggtgaaacggtggcgtcttggcggcgcaggttagccttaacccgggccactagctcacggttagaaaacggcttggtaacgtaatcgtcggcccccaactcaaggcccaaaaccttatcgagttccgaatccttagccgttaccatgatgattggcgtcgaacgcttagcccgcacctgcttagccacttccaggccgtcaattttgggcagcatcaggtctaagacgatcagatccggtgactcgctttcgaccttttgcagggcctcttccccgtcgtaagccacgacgacttcatagccctccttttctaggttaaacttaatgatatccgaaatcggtttttcatcgtcaacaaccaaaactttcttggccatgtcggtccctccgcatccatcttttttcattcttcgttaattgatcgtaaacttaattataccacaccgggtgggtggatcccggccctccaacttttttcacaaaaaggtcttgccaaattagaccacatctgatatagttaataacgttgtgttagacatgacatgggcagttagctcagctggcagagcaccggactcttaatccgggtgtccagggttcgatcccctgactgcccatttcgttccgtcaccgcttgggtggcggtttttttgtataaaaatggccatcctcaattggcggtggggcccactttccctggtccccgatcttttttaaaaaggggcttgccaaaacgatggtcaactggtattatattttatgttgttaagacatgggcagttagctcagctggcagagcaccggactcttaatccgggtgtccagggttcgatcccctgactgcccatttcattccgtcaccgcttgggtggcggtttttttatacaggaaataaaaaatccccaccgcccaaatgggggaggggatcataattgaaattacttttcgtcagcaggtgcttccttagcccacttacggatagcttcaatcttcttttcttttaaagcccgcttgtacttcggagcaattggacgccggccttgaacgccgtgtggatgtgctttgcgcatggttcatgcctcctttatctctctcgtaaatatttcaacattccgattataacgaaagtcaccttaaatagcaaccatcaatcgccaacggaaaatctaggcggcatgattggacaagcacaagtgaaatgggtacaatgttgtttgtattggtggtacccaatttgggtgaactttgttaaaaaatgcacgacgatggctgtattttttggctaatggtgatacacttaatgggtacatgaattattttcctaaaggaggaaattacagtatgactgtaaagattggtattaatggttttggccggattggtcgtttggctttccgtcggattcacgaactcaactctgacgaaatcgaagttgttgcaattaacgacttgacgacgccgtccatgctggcttacttactgaagtacgactctacgcacggcaagttccctggtgaagtttctgcttacgaagaagggatcattgttgacggtaagaagtacccagtttacgcagaacgcgacgctaagaacattccgtgggttgcaaacgacggggttgactttgtcctcgaatgtactggtttctacacttctgctgaaaagtcccaagcacacctggatgctggtgctaagcgggttctgatctccgctcctgctggtaacattcctactgttgttcctggggttaacctggacacgctgaaggctgacgacaagatcgtttctgcaggttcctgcaccacttcttgcctggccccaatggcttacttcctgaacaaggaattcggtctcaaggctggtacgatgacgaccatccacgccttcacttccacgcaagcgatcctcgatggtcctcgtggtaagaagatgcgtaacaaccgtactgcaagcacgaacaccattccgcactcttctggtgctgccaaggccattggcctggttatcccagaactgaacggtaagctttctggtcacgctcaacgtgttggtgttgttgacggttccctgacggaacttgtttccatcatggacaagcacgttacggttgacgaaatcaacgccgctatgaagaaggctacggaaggtaacgacgcctttggttacactgaagacccaatcgtttcctccgacatcattggctccacttacggttctgtctttgacccatctcaaaccgaaatcatggaagccgacgatggttcccaattagttaagacggttgcttggtacgacaacgaatacggtttcaccagcaacatgatccgcaccctgatccactttgcaagcctttaattgcaagctgaattaaggtgatcaaaaaggcgggaggaggcgactcccccgtcttttcttttaaataaggaggaagatttcatggctaaattaacggttgaagatttagacttggccggcaagaaggtcttaatgcgcgttgacttcaacgtgccgattaaggatggtgttgttggcgacgacaaccggattgtggctgctttgccaaccatcaagtacgtattggaccaccaggggaaggcaattctcttctcccacctgggccggatcaagaaggaagacgacaagccgggtctgtccatgcgtccggtggcagaacgcctttctaacctgctgaacatgccggtaacctttgtaccggttacggaaggtccacaattagaagacgccatcgccaagatggaagacggccaagtactggtggttcaaaacacccgttacgaagacgttaaggacggcgaatacgttaagcgcgaatctggtaacgatccagaattgggtaagtactgggcatccttgggtgacctcttcatcaacgatgccttcgggactgctcaccgtaagcacgcctccaacgtggggattgcttccaacatgccaggcaaggcagcggcgggcttcctgatggaaaaggaaatcaagttcttaggtgacgccgttaccaacccagtacgcccatttgttgccatcttgggtggtgccaaggtttccgacaagatcggggttatcaacaacctgctcgacaaggctgataaggtcattgtcggtggggggatgacttacaccttctacgctgccaagggcatcaagatcgggaactccctggttgaagaagacaagattgacgttgctaaggaaatcttggaaaaggctggcgacaagttagtcttaccagtggataacgtagttgccgacaagtttgccaacgacgctaacaccaaggtggttgaaggcgacatcgatgacggctggatggccttagacattggtccaaagtcaatcgaagaatttaagaaggtgctggcagacgctaagaccgttgtttggaacggcccaatgggtgtctttgaaatgagtaactttgccaagggaaccttggaagttggtcaattcttggggacgcttgaaggcgcaacgacgatcgttggtgggggtgactccacggcggccgctaagcaattgggcatttctgacaagttaactcacatctccactggtgggggagcttcattggcctacctggaaggggacgttcttccggggattgctgccatttctgataagtaaacttgaaaggggttggaaagaaaaagtttcccacccctttttcgtttttttgtggaatacagagtaggttgaattccatgttcttttttacgtgggggtgattgaatgcgaaaaccattgattgtcggcaattggaagatgtataagacaattacggaagcggtcgattacgttgaccaaatcaaagacgccctgccggatccggaacaagaagaagtggagctggcggtgccaaccctctttttggagtcgctcgtcgaacacacccgggggaccaatttaaagattgtagccgaaaactgcttttaccaagacgaaggggcctttactggtgagaccagccccttagccctacgtgaattaggaattaagcacgtcatcatcggccattcagagcggcgccgcttgttttatgaagacgacgccacgattaacaaaaaggtccatgctgccttgagcgccgggatttgcccgattttgtgcgtcgatgaaacgatgaaacgcaagcaggagcacgatcggattgtctgggtggtcagccaagtcatttccggcctccaaggggtcaaagaaagcgagctttcgcgggtgacgatcgcctatgaaccaagctgggcaattggtagtggtaacgaggcggccaccccgcaagaagccaatgaggggtgttacctgattcgccaaacgattgcccacctctacaacgatgaagttgccaaccaagtacggatcctatacgggggtagcgttaatttgtctaacatcaagaccttaatgcaaaaagacgatattgacggggttttgattggacgggctagtttggacgccaccacttttttagagatggttaactaccaacgctttggtcactgatggactggttaaatttcccaggaaattagcgatctgacttgttttaaactgatcaaaataatagaatggaaggcggaattgctttccaaataaaatcaagaggagagagtcatctaatgtcacttattacagatatttacgcccgtgaagtccttgattcacgtgggaacccaaccgttgaagcagaagtctacaccgaagctggtggtgttgggcgggggatcgtcccgtccggtgcttcaactggtgaacacgaagccgttgaacttcgtgacggtgacaaggaccgcttcggtggcaagggtgttttaaaggccgttgccaacgttaacaacgttattgctaaggaaatcgtcgggatggaagttacggaccaaatcgcgattgacaaggcaatgattgccctcgacgggacgccaaacaagggtaagttaggggctaacgccattctggccgtttccttggcaaccgcacgggctgctgcagatgaactgcaagttcctctttacaactacttgggcggctttaacgcacacgtaatgccaacgccaatgatgaacgtcatcaatggtggggcccactctgacaacaaggtggacttccaagaattcatgatcatgccggttggtgccccaaccgttcgcgaagccatccggatgggttccgaaactttccacgccttaaagaaggccttggaagcagatggcaaggttacttccgttggtgacgaaggtgggtttgccccagacttcgctaacaacgaagaaccgttcgaatacctgatcaaggccatcgaagctgccggctacaagcctggtaaggacgttgcgattgcctttgacgtggctgcttctgaactttggaacgacgaagacaagaagtacaagcttcactggtccactggtgaagaatacaccaccgaagaatggatcgaatacctttccgacatcatcgctaagtacccggttgtttctgttgaagacccgatcgacgaaaacaactgggatgactgggtaacattgactaacaagcttggcaagaaggttcaattggttggtgacgacttcttcgttactaacaccgactaccttgctaaggggatcaagatgggcgctgccaactcgatcctgatcaagctgaaccaaatcggtactctgacggaaaccgttgaagccatcgaaatggctaaggaagctggttacacggccatcgtttcccaccgttctggtgaaactgaagacacgacgatcgctgacttggtggttgctactaacgccggccaaatcaagactggttccatgagccggaccgaccgtcttgctaagtacaaccaattaatgcggattgaagacaaccttggcgacgttgctaagtacaagggaatccgttccttctacaatcttagtgaacaagctaagcaagacatcgaaaaccgttaatttggttgattaaaaagagaccggaagaaaccctgttttcttccggtcttttttaatttctggtgataatttgatgagacccgcttattgccccctcgggacggatcgcctataatgaaaaatagttgttttggcgctttgccatcgtcaagggggcacggtccccctttaacttagagaggaattgaaaataatgaaacagcaatcaagtggggcgcccgaactgcggcgttcgatgacagctggtcaaatggagatgatctccttagggggagccatcggggttggtttgttcatggggtcgacgtcgacgattaagtggacgggaccatcggtgattttagcttacgccttcgttggtttgattctctacattgtcatgcgggccctgggagaaatgatttacgttaacccggggaccggctcctttgccgattatgctaccgaatacgttcacccaattgccggttacttagctaagtgggccaacgtctttgaatacatcgtcgtcgggatgtcggaagtggtggccgccacggaatacctgcagtactggtggccacacaccaagccctgggcggctgggttggtcatcatcgccttcttggccctcgctaacttagccagcgccaaggcttacgggtcattagagttttggtttgcgatgatcaaggtaatcaccattatcctaatgatccttttgggctttatggttatcttctttggctttggtaacggcgggcaccccaccggcttttccaacctgtggagccacggcgggttctttaccggcggcatttcgggcttcttcttttcgatgtcaatcatcgtcggttcctacgaggggattgagttgctgggaatttcggccggggaagtagctaacccacaacaggcgattgttaagtcggtcaagtcagtcctcttcaggatcctgatcttctacgttggggcgatctttgtgattgtcaccatctacccgtggaaccacctaagtgcggtggggtcgccgtttgtttccaccttcgccaaggtgggcatcaccgcggctgcctctttgattaacttcgtggtcctgacggccgccctttccggggccaactcggggatctattcttcaagccggatgctctttaaattggctcacgagggcgatgcgcctaagatttttggccgcttgtccaagcacgtggttccggacatggcgatcctggggatttctggggggattttacttggcttcattgccgacattttcgcaacggtcttttcaaagacgaccaccgatatgttcgtgattgtcttctcgtcttccgttttaccggggatgatcccgtggtttgtgatcctcttggctgagttgcgcttccgcaagcacaacccgtccctaatgaaggatcatcccttcaaattacctttgtaccccttatctaattacttcgcctttgccatgctggtggtgattgtggtcttcatgttcgttaacccagatacccggatttcagtgattgccgggacggtcgtcttggtggtggccgttttagcctacctgatccggtaccggggcaacttgcgaaaagaaaattagcttaaacaggtggcgacgctttcagccctaagcgccgccctttttttgtgctaaaataatttggtaacttataagggggctctggagtagtgttcagatttaaatttttaaagtatagcaacgcccggtcggtgggacgggcaattgtgattggggtggccgttgggttagtggcctcggtctttcggttggcgattcaagacgtcttggtcctcaccaagctggcctttttgttcttccaccagcagccgctatggctattggcgtgggtagcggtaaccgtcccgttagcccttttcttggggcggatggcccaaaagaaccccaacattaagggctcggggattccgcaagtcgaaggtcagttaacgggccagttcgacgagcaatggtggccagtcttgtggcgcaagttctttgggggtatcctttccatcggtcccggtctcttcttgggacgggaaggaccgtcaattcaagtcggggccacggttggccaaggcatcgtcgaggggcggggaaagaagaaactgaccgccattgagcgtcgggtggggatcgcctccggagcggctgctgggctttcggcggccttcaacgccccgatcgcctcctcaatgtttgtcttagaagaggtttaccataacttctccccgttagtatggctatcggtgtttatttcctcgatcagtgccaactttgtgtcgatgcaattctttggcctcaagccggatttagacctgccccacgaaatgtatttcccggtcaatcagtacgggtacctattgttattagggttcttcttggggattttagggcggctgtatcagtacgtgatcctacggctagggacgtggagccgcaaggtaacgtggtttaagcccgcttggtacccggtgatcccattcttgttggtgattccaattgcttggtggtggccaaacacgctggggggcggtaacgggttgattattagtttgaccaacctgccgacctcagtgagcctctttttgtggttgtttgtcctccggtttgtcttctccatgatttcctacggttctgaattgcccggggggattttcttaccgattttgaccttgggagccgttctcggcgggctgtactgcgtcattttgattcacctgggcctaattccggcgcgctttttagccaactacgtgatttacgccatggccggctactttgcctgcatttccaaggcgcccttcacggcgatcctgttgattacggaaatggtgggttccctagcccacctcatgccgttagcggtggtggcggtggtggcctacctagtcgtggacgtcttaggcggtgctcccgtctacacggccatgtttgaaagcttcattcatcgtcaaccacaccagtccctggaggggattacgcagatgacgacgaccatctacgccgggaccgcccttgacggcgccttagttaaagactacccgtggccaccatcctgtttgattttaatggtttaccggggcgaagaagaaatcgttccccacggtgatacccgcctccaggtcggtgacaccctagtaatccagctaaccggggccagtcacctcaagtcccaacaagcgatcattagcggtgcccaccaggtgattgattagcaatttaggcttttctatgttaaactctaagggttatagtgtgagcagataggaggaagatcgtggaaaatacgttaatgaccctgtttttgatcgattgcgtggtcatgatcgcgtgcgtgatgatgcagccggccaaaaacgataacgattcgatgtctgctttgaccgggggaagtggcgacctcttctcccggcggaaggcgcggggcttcgaagccgttatgcaaatcgtaactgtcattgtgggaatcattttctttgttcttgctttggcgctggtttacgtttcctcacattagtagtgagcgcctccgtttaacgggggctttttttgaacgcgaaaggaataagatgacagatttaaagacacaaatactagactacctcacggaaaacgcggccctgagtttctcggccgaaaagttggcccgggtgctttcaatgaccagtgcggacgaattcacccccctggtgcaggccctcgttcaattagagcgggaaggaaaagtggaagtgacggatgatggtgaatttaagctggttccccaggtaaaggaattcactggcgtttttcaccgtaaccccaagggctttggctttgtttcctatgacccggaaatgccagatattttcattaacccggaccacacgatgtgcgccctaaccggtgatgaagtggccgttaagatcttacaagcgggcgatccaacccgcgaccagaggccggaaggggagatcacgaagatcattacccgctcctacgaccacgtggtgggggaatttaagaacatgacgatgggcaacttcatcggtgaagtgattttaaaggataaaaagctggggagcctccgcttttacgtgaccggcgatgggattcacccgcaggataatgaagtggtcaccgcaagcattgcgacctacccaagcgaagacgctccggaggtgatgactgggccggccctggaagtgatcggggataaggatgaacccggcgtcgacattctttcggtggtgtacgcccacgacgttccccacgaattcccaaaggaagttttggaccaagccaaccaaatcccgttgaccgtccaaccagaagaaaaggtcgggcgcccggatttaactgaccagcccttggtaacgattgattcaattgagtctaaggacttagacgacgccgtggtggcttggaagcttgataacggcaactaccacttgggggtccacatcgccgacgtttcccactacgttcaaccgggaacgccactggacgaagaggccttcaagcgggggacgtcggtttatttgaccgaccgggtaattccaatgttgccgcggcgcctttccaacgggatttgttcccttaacccgggtgaagaacggttagccatgtcgtgtgaaatggaaattgacccccaaggaaacatcgtgagccacgagatcttcccgtcggtgattcgttcgcacgcccggatgacctataagggtgtcaacgccattttagaggcccacgatgaaaagacccgccaggaatataaggaactggtgccgatgtttgaaacgatggccgacttgcaccggatcttgctcaagcaccgccaccaacggggggcaattgacttcgaagccccggaagcgaagatcatcgtcgacgagaatggtcacccaaccgacatccaattacgcgaccgcgggctgtcggaacggatgatcgaatccttcatgctggcggctaacgaaacggtggccaagcactacgatttgatgcacgtaccattcctctaccggatccacgaacacccggataccgaacggattaaaaactttgctgaattcctctccgttttcgggattaacatgccgggggacctcgccaacgttgagccaaagatgttgcaaaaggtgcttaagcaagttgccggcacgccagaggaacaaatggtccaaacgatgatgctgcgcagtatgcaacaggccaagtactccgaagatgagctaagccactttgggctgggagcccagtactacacccactttacgtcgccgattcgtcgttacccggatacgaccgttcaccgcttgatcaagtggtacaaggaaaacgggactaccgaagaggccaaggccaagtaccgggatcgcctagcggaaattgctgaacacacctcagtgacggaacggcgggggattgataccgaacgcgacgtcgattcgatgaaaaaggctgagtttatggaggaccacgtgggcgagacctttgacgccgttgtctcttccgtaatgaagtttggcctcttcgttgccttggagaatacggttgaaggtttgattcatatctcggtgatgaacgatgactactacgagtacatcgaaaagcacatggccttggtcggccgggaccaccaccacatcttccagattggtcaaccagtaaaggttaagctattgcgggttgataaggatcaacgcgaagttgacttcgagctggtgaacgccgatgaagcgccgctgactaagctgcgggcaccacggcaaaatgaccgccgcaacggtcgtggtcgcggcaacggtaatggacggcgcaataataacgggcgccgtcacttctccgatgaccacgatcgtgataacgggagtcgtaacaccacccagatcaaccgggggcaaactcgtcaccgtggcgaccgggataataatggcgaccgcaatcgtcgccgcaacggtaacggacaaaaccgccgccactagactgcaaaggagagaacagaatggcgaaaaagaaccaccaggggctcgacgccaacctgattgcccaaaataaaaaggctcgtcatgactacacggttaccgacacctttgaagccgggctcgttttaaccgggaccgaaatcaagtcggtgcgtgcacggcgggtcaccctaaaggatggctacgcccaatttcataatggtgaactctggttaatgaacgtccacattgccgaattcgcgggtggtaacatctttaaccacgacccgttacgtaaccggaagctcttattgcacaaaaaggagctcaagaagttacaaggcgaattaacggccaagggggttaccctcgtaccgttaaaaatgtacttgaaacacggctacgccaaggtgctcttgggccttgctcaagggaagcacgagtacgataagcgtaacgccattaaaaagcgtgagcaggaccgccagattgatcgggtcatgaagcattactaataaaagccaaaagcccaaccgccggagttatcggcggttgggctttgtaattggactggtggttactagtggggacagtccccggagcgggtggggatcatcgaccctgcgggggtgccaggtaaccgctagttcgtgatcgggacggtgggcccagtggtttaggatggtggccactaaaatggcgaggggttcttcgtcttggtcggcaatgtgaactgcttggtagagccccccggtgtcttcaaggggactagttgaaaagaccagccggttcccttgatagacccggtaacggtcagagaggggagagccgaccaccatccagttgagcccacggatgtagatgacctggcgtacaaaccctagcgatttagcgatcacgccaacccgttggcggttttggtagaggacaaatttgggccacagccctagcgtaacctgcttcacctcagcgagcaggctcccttgcatggtatacaaggaaagaacgtcttggcgcagcccccacttaccggtaagcaagtaacatgcattattgaattcatcgtgaacgatggtggttgcctgacgttgaccaccgtgctcacgtaggtatagggtgcgcaccaaaatccctcccttaaatattagctatctgtattctaacaggaactgcgcttaatttcacgaatcgacaacgaaaacggtttcgttcaaggctactcccgcttgggtgagtgtgctaaaatgtttacgaggtggcagaagtgaaacagttaatcaacaatgattggtggccggtgttaaaaccacagtttgaaacggccaactaccagcaattgcataatttcttggtggatgaatatggccaccagcaggtctaccccgagatgcaccacatctttgaggcctttaattggacccccttttcgaaggtcaaagtggttattttggggcaggacccgtatcacggaccggggcaggcccacgggtgttccttttcggttttaccgggagtggctgtgccaccgtccttgcaaaacatttataaggaactccaagccgatttggggtgcccgcccgtcaagcatggctacctcaggtcctgggccgagcagggtgttttactgctaaactcggttctgacggtgcgggctggccaggcttactcccaccaagggcacggctgggaacagctaaccgacgcggcgatcgtcgccctgtctaaacggccgaccccggtggtcttcatcttatgggggcgggcggcccgggataagaagcgtttgattgacctaaagcgcaactttgtggtggaatcggcgcacccgagtcccctgtcggcttaccggggcttctttggttcgcggccgttttcaaagaccaatcagtttttggagatgaccggccaagccccaattaactggcaactgccgtcgactgtcgaccacctgtagtatctggtacatttagaacggaggaaccatcgaatggacatttttgaaaagttagctgaccaactgcgcggccaagataagacgatcgttttcccggaaggtgaggacccacgtgtgttaggggcagcaatccgcctgaagaaggatcaattggttgaaccagtcgtgcttggtaaccaagaggccgttgaaaaggtcgctggggaaaatgggttcgacctgactggcctgcaaattcttgatccggcaacttacccagccgaagacaagcaagcaatgcacgatgccctattggaacgccgaaacgggaagaacacaccggaacaagtagaccaaatgctggaagacatttcctactttgccacgatgctagtttacatgggtaaggttgatggaatggtttccggggcggttcacgcaactggggataccgttcgcccagcccttcaaattatcaagactaagccaggttcccaccggatttccggtgcctttatcatgcaaaagggtgaggaacgttacgtctttgctgattgtgccatcaacattgaattagacgcgccaacgatggccgaggtggctagccaatccgctgaaacggccaagctgtttgggattgaccctaaggtagccatgttaagcttctccaccaagggctcagccaagggggacatggttaccaaggtcgctgaagccactaagctagccaaggaagccaacccggacctcgctatcgatggggaactgcaatttgacgctgccttcgttccatcagttggggaactaaaggcccctggttcagacgttgctggccacgctaacgtattcatcttcccgagtctagaagccgggaacattggctacaagattgcccaacggttcggcggctttgaagccatcggtccagttttgcaaggattaaacgccccggtggctgacctctcccggggaacggacgaagaagcagtttacaaggtggccttgattacggccgcccaggcactttaaggatcaccatgaaacaatttacctttaatactccagaacaaacaaaagaactcggccaaataatcgcgtcggggttacgggccggggacgtgctcgttttaaacggcgacctcggggccgggaaaaccactttcaccaaggggctggccaagggcttaggcatcgatgaggtgattaaaagccccacctttaccattattcgtgaataccaaggggggcggctaccgctttaccacatggacgtctaccggctggaaaacggcggggcagaggacctgggtttggatgaatactttgacggtgatggggttagcgtggtggagtgggcccaatttgcggctgacgaattaccagctgattacctagccctaacctttacgcgcaccgatcaagataaccaacggaaagtacagttagacccccatggcgaacactttacttccctagtggaggcattgtaatggcagacgaaacggtatccctacgtgaagctaagccgaccgatgcggccgcgctgttagccctgttaacacagttacaaacggaaaccaacgcgattgtctacagtaacctagcgaacatgacggtcgaacgtgaggcccaaaaccttgcccagatcgcccgctctaacactgggatcattctggtggccacttaccaaggtaagttaatcggcttggccaccgtgatgcgcatagaaggagacgcgaacgccggcgaactaggcttagcggtccttaaggattactggcacaacggaattggctcattactacttgacgaggccctctactggtttgtaaattttgcccagctagatcacctggtgctggacgtttacaagagtaataaccgggctcgccggctttatcaacactacggctttgtcgaggtggcggagtgcaccatcaaggacagtgatggccatgaccagccggctgtttcaatggagtatcaaggaattgaggaattgtgattccgtaaacgctaagaggctgggagaaaacacggttttctcccagcctcttgctgtatttgtaagtgttaaactgaagccgacccttgccctagcttagtcgtccacttcacctaattacgacctttcttagcggttgaccacccgaacgaagggtctaagtggcgccgtaccaaagtgattagcctggtacaaaaggatgttggcgcaggcgtgggcgtcgtctaaggcattatggtggtgatgtaggtcgatattgagctggtcacagattgtattgagcttgtggttgggaaacgccgggaacagctggcggctggtctttaaggtgtctagcgtctggtagaccgggggctcaatttcaaagtggagcagggtatttttcaaaacgctgttgtcaaaggtggcgttgtgggcaatcacgagcttatcgggcgtgaagaattcttggatgtgctcccacacctccggaaaggtaggggcgtcttttacatcgcgctcgtggatcccgtgaacctgggtgttacgccaaaaaaagggcgtttgcgggttaattaaggtataaaactcatcttggatctgactgttacgaacgatggtgatagccagtgaacaagccgaaaaacgtttcgcactagccgtttcaaagtccatggcgataaagttcacgaacaagcctcctttcattgctgacttcattttaagtgatggttgccggattggcaaacgaacaagaatcttgggggagtaaatgctataattggcaaagtgatatcaaaaagaagggatcttgcagatggaaaacttgataaccacctttccagaaattgaaattaaagaacacgagcccctggctcactacaccaacaccaaaaccggaggcccagcggactggctggcctttccggtcgacgtggcccaagttcagcaattagttgactactgccaccaaacggggttagcgctaacggtgattggtaatgcctctaacttaatcgtccgagacggcgggattgaggggttagtgatgatcctgacccggatgcaaacggttaaggttgaaggtacgatggtaacggcggccgccggggcttcttacatcgaagtaaccaagatcgctagggatcattccctgaccggtttagaatttgcggccgggatcccggggtcgattggtggggccattttcatgaacgccggggcctacggtggggaaactaagaccgttgtcgatcacgttaccgttatggaacgcgacggccaaatccaccagctatcaaacgaagaaatggactttggctaccgccactccgccgttcaagcaagcggggcgatcgttttagacgccacctttgcccttaagttgggggaccaaaatgccattacggcccaaatggaggatttaaacgcccgccgtgcggctaagcagccgcttgagctcccttcctgcggttccgtgtttaagcggccaacgggctactttgccggcaagctaattcacgatgcgggcctgcagggttacacgtctggtggggcgcaagtgtccaccaagcacgccggttttatcgttaacgttaaccacggcacggccactgactacttaaacgttattcaccacgttcaggaaactgtgcaagaaaagtttggggtccaactggagactgaggtgcgcattatcggtcggcaaagctaacgggggtggttatgatgacctatttggcggcactcttaacgtggcgcaacttcattaatttaatcgacatcctggtaatttggtttttaatttacgagttgatggttctggttcgggggacccgagccgtccagctatttaagggaatcatcattatcattgtggtaaagctgatctcttggtacattgggctgaccactgtgtcgtgggtgatggaccagatcatcaactggggggttatcgccatggtggtgatcttccaaccagaaatcaggcgcggcttggaacacctcgggcgggggaccatgtttacccgtaccaaaaccgaaaacgaggaagaagaagccctgattacccaactcgatcaggcaatccaatacatgtccaagcgccggatcggggctttaatcgccatcgaaatggataccgggctagaggaatacattgaaaccgggattccactggatgcggaagtgaccggggcccttttaatcaataccttcatccccaacaccccgcttcacgacggggcggtgatcatcaagggcggccggattgccgtggccgccgcttacctaccgctgtcggattccaagttaatcccaaaggaactggggacccgccaccgggccgccgtgggtatttcggaggtgacagacgccctgacgattgtaatttctgaagagactgggggcgtttcgatcactaaggataacgaattgatccgggacatgacccaagaaaattacctcaaattcttgcgggcccacctttataaaaaggagagcaccgatcagaataagcttttggaccggctggtaaacccgttccggaagggaggacgtcatgaaaaataacgataatagcttcttcagtcgtccgtgggtgatgcgcgggacgtcactcgtcttggccctgttcatgttcttttacgtcaacggctcctttttgcgtcaaaccactcgccagggtaatcaatcggccctgatgtcagacaagtcccaaaccattaaggtccccttgcaggtctccattgatagcaagcgctacgtggtaactggctacccgcagtacgtcaagattaagctgaccgggccatccgctttggtaaccaccaccgtcaacacccaaaactttaaggtttacgctgacctcagtgacctggggaccggtcagcaccgggttaagttgaaggtgtcgggattaaattccgagctgacttccagcatcgatccggaaacgatcacggtcaatatccaatcgaaaaagacgatcacggtaccggtcagcgttcaattgagtagcaagaccgttgccgatggctacgaggttgggacggccaagtcttcaatggccaacgtccaggtttccggggccaggagcgaggttgctaaggttgccaaggtggtagcctttgttaacgtgccccacacggcgacggccaccttcacgcggcaggtaaccttacaggccgtggataagaacggccaaaccttaaacgtggtcgtgacgccggataccctatccgtaacggtaccgatcacaagcactaaatcgtcatcgtcaagtgatagtggctcaacgtctggctcctcaagcagcagttcgggttcgtcagacaccgaaaccagttcagccacgtcgagtcgtcaatcatcggcgagctcccaaacggagacaaggagctccagtattcaatcagctagcagttcagcgagcaactagtagtcaagaaattaagcagggaagaaacgaggaagaatcatgaagttaaattattttggaactgacggtgtgcgtggcgttgccaaccgggatctgagtccggaactagcctttcgggttggccgggctgggggatatgtgttaacccgtcactcccaacgtaagcgcccacaagtgctagtttcacgcgatacgcgaatttctggggaaatgctggaaaacgccctggtggccgggctcttgtccgtcggaattgaggtatttcgcttaggggtggtgaccacgccgggagtggcttacctggtacgggcccaagaagcggacgctggggtgatgatcacggccagccacaacccgattcagtacaacgggattaagtactttggtggtgacggatttaaactctccgacgagctggagtacgaaattgaacagctcttggacgccgaagaagacaccctcccacggccgagtgacgatggcttggggacggtggaagactaccgcgagggggcgttgaagtacacttcctttttggagcagaccatttcaaccgatctggacggcttaaaggtggttatcgacggggccaacggggcaacgtcatcgtttatcgccaacctttttgccgacgttaacgccgatttcattccgctgcacgtgtcaccaaatggcttgaacaccaaccttaattgtggttccacccacccagcggacctccaaaaggccgtggtggaaaaccaggccgacctggggattgcctttgacggtgatggggaccgttgtatcgccgttgacaacgaggggaacctggtcgacggtgataagattatgtacatctgtggtaagagcatggaagctaacgggcgtttgaaaaaagacaccgtggtgacaaccgtcatgtctaacttaggaatgtacaaggccttagaaagtcacggtatgaagagcgttaagactaaggttggggaccgttacgtggtcgaagaaatgttaaagaacggctataacctcgggggggaacagtccggtcacatcatcttcttggatcacaacacgaccggggacggcatgctaaccgctttacaattgttgcaggtggttaagaccagtggtaagagcctcaaggagttggccgcagacgtcgtgacctacccacaggagttagtaaacatcacggttgaagataaagaagcggccctaaacaaccaagaattgaagaacgccattgccaaagtggaagaaaagatggccggcgacggtcgaatcttggtacggccgagcgggacggaaccgctgctacggatcatggccgaagccccgactaaggaactcgttcacgcttacgtcagtcaaattgccgacgtggctcggcaagtcttgccaggggcaaagtaaaattcgtaaaaggactgagaggctgggaaagttattcccactctcagtctttttagttggggtgcaaaaaagtcaaccgcttgatagaccaatttgggtgctcttggttgacattgttcgccattattattatgatacgtattgttaaggaattatcttttagcgagaatttatctataccaattttaaagattaaaggatggaattgctaatatgtgtggaatcgttggaattaccggtagcgaccggtctgttgaaatcttattaaacgggctcaagagcctggaataccggggttacgactctgcgggaatttacgttaatgatcaggcgggacacgactacctcgttaagcgtccggggcggatcagtaacttggaaagcgccttaacgccggatgttcacggtttggctgggatcgggcacactcgctgggctacccacggggaaccaagcgaagtaaacgcccacccacagtactccacggatgaacgcttctacttagttcacaacggggtgatcgaaaactacaagcaacttaaggaagaatacctgtcagacgttgacttcaagagccaaaccgacaccgaagtcatcgttcaactggtggataagttcgtggttgaatacgaaatggacactaaggcagcccttgtaaaggtgttacggttgatttctgatgactcagcctacgcctttgtcttgattgacaagcaagaaccggacacccttttcgtggctaagaacaagagcccacttctggtagggctggccgatggttacaacatggttggttccgatgccttttcaatgatcaaggaaactaaccagttcatggaaatcgacgaccacgagttggtgatcgttaagcctgacaacgtagcgatccaagacttcgacggtaatgaaaagaaccgcaagccgtttacggttgatatggacgccaatgccgctgataagggcgcttacccgttctacatgttaaaagaaattgacgaacaaccggccgtgatgcggcggttagtttccgaatacctagacgccgacggtcaaccaatggtggaagaacaaatgctggctgacattgctgatgctgaccacatttacatcattggggccgggacgtcttaccacgccggcttagtcggggcacggatgtttgaaaagttcgccaagacgccaacgacggtgcacgtttcctctgagtttgcttacgaacaaccactactgtccgccaagccgttcttcatcttcttatcccagagtggggaaacggccgacagccgggaagtgttggtcaacgtcaataagaaccactggccgagcctgacgatcactaacgtcgacaagtcgaccttgtcacgggaagccacctatacgatgctcttgtttgctggccctgaaattgccgtggcttctactaaggcttacaccgcccaaatcgccgttgaagcagtattggctaaggccctgggtgaatacctgaagagcgaagacgctaaggacttcgatttaaagcacgaattggccaccgtcgctaacgggatgcaagcaatcaccgatagcaaggacaagctcgaagaaatcgtcagccactacctttccaagccgcgtaatgccttttacattggacggggagtcgactgggcagtttctttggaagcggccttgaagctcaaggaaatctcttacgtccaagcggaaggtttcgcctccggggaacttaagcacgggacgattgccctgattgaaaagggaacgccggtaatcgggatcattacccaggaccggacggccgggttgacccggagtaacttagaagaaacccaggcccgcggtgcaagcatcctaacgatcgtttcccgccacctggccaaggaagacgatacggtgatcttaccggacgtgaacccgtacctgacgccgttactgtccgtggtaccagcgcaactgttggcctactacaccagtttggggaagggcttagacgtcgataagccgcgaaacctagcgaagtctgtaaccgttcaataattaaattgatttagacacttctcaggaccagaagtgtctttttctttctgagaattagattaaaatcagtgtaatgacttcttttttgccagtaaacattgacagcgcttacaagatcgcctattataatgacataaggtattaagtatttaccttctaatcaattctctttctctcttatgccgatcactgccttcccgggcagtgattttcttttttcaccgcttttttgctgtgaacagcgtaaaatagggggagataagaaaaaaggagggatttgatggcacaacgtccaggaacgctggatctgattgaacagattacccggcttgacgggactaagtactttgaaattggtaacatggtccacaacggtcgcgccgaactggcggctgagcggggctacattaaggaagtccggattttgaagttaaacattccgcactcccaaaccgtaattaagtacgaaaactacgtcaacgaacacttttattcacaagaagaaacgatggatcactgggaggaatgggaaaagaccccagccgaagaggagctggtggaaaccattctgcgcgaaaatcacgtcggataggaggtcgacatgcaaaagatcaggccggaaaggaccgaccaggggagtcgctacgttacgggagtggacgggatgcggacgctcgcggtggtgggggtcatcatttaccacctcttcatcgcgcagttaccagggggctttttgggggtgcccctcttcctgttgatttcgggttactttgtcactgaccagctgcaaaacgagtgggaccaacatcaaacgatcgacctcattagtttttaccggcggcgtttccgacgcttgtatccgcccctggtggggatgttgttggtgacggtagtttacattaccctgtttagccaccagctcctttaccaactccgacaggtggtggtgaccaacctgctgtgggtgtataactggtgggaaattggccacggccagtcctacttcgatcgcttcagtggcgagtccccctttacccacctctggaccctcggggtggaggctcagttttatttaatttggcccgccctgttgtttatcgtgttagttggtttgggcaagcggcgccggttaattaagtggttgaccctgaccctggccgtgttatcggcggttttgatggcggtcctgtataacccagccaatttaaaccgggtctattacgggaccgacacccgtgctttttccctgttactgggggcgtggttagcgatggtgtggccgcgaaaacacctccggggcaatttgccccccaccgggaagacgatcctaaacgggggtggggtcattagcctcctaataattctaattggcttttgtagcttggatgggcaggccaagtttacctactttggcgggatgttcttgtacagcctcgccgggatggttttattggcgacaattgtccacccgggggcgtcgatgaatcgttggctaaccaacccggtcttttcttggatcggacgtcggtcgtatggaatctacatttatcaattcccgatcatgatcttttacgaggccaaggttcaagtcggggcgcaccccttcatcaatggcttcattgaggtggccatgattttggtggcggcggaactttcctaccgcctagtggaaatgccggccaaaaacctccagcttaaggaactggtggggaaactcaaaacgcggccagcgggcctcaaacggtgggttcggctgggagccactagtctcttggtttgcgtagcgctagtcggattagcgctgccggaaaaggcgccggctaagaccgccttacaaaaccacttaactaaggcgaacgaagctacggccgctcgcaacaagttaattgtggcggggaaggcccccaaggtaaatgttaacgctaagtctttgaagacgaagtaccaactgagcacgaaacaaattaaggccttggggaagctaaagatgaccgtgattggggattcggtaatggccgacgccgctcaaaacatccaagaactggtgcccgacgcatacgtagacgcacaggtggggcgccaggggagtgcggggccggccatcattaaggaactcaaaaagaacggccgcctcgccaagatcgtggtcttaaacctgggtactaacggtccaatgaccacccaaacggtcaacgaaatcctagctgcggttgggaaggggcgccagatttactggattaacgcccacttaccaaccaagagctgggagaagacggtcaacagtcagttaaaaaagactgccaaggagcattcaaacgtccacttagttgattggaatgcccaatccaaggggcacgccagttggtttgccaaggaccgggttcacatgggaccggaagggaatgtccagtttacccggttgctactgaccacgattcttaaaaatgaatgattatataggaagaaagaagaattgaaaccgatgaaaaagatgattgcactcgacttggacaacaccctgttaaataaccaaaaggaaattagtccggctaacacgaaaatcttacgccgccttcacgagcaagggataaaggtggttttatgtacgggacgaccgattaacgccatttggcacttgattgagcaactggacctgacccggccagatgactttacgattacctttaacgggggcctcgtgatcaacaatcaatcccgtgaggctctctaccaaaacgggctgagtaaggaggatctggtcccagttcacgactttatggccgcgcgccggttaccgatggacgtgttggactttgaacagatctatgaaattgatcccgaccaccgctccttgtaccagcaaacggttaaaaacatccgctttgaagacaccacctttgagcagttagcggcagaagaccacgtttacgccaagaatgtgatggcgattccggctgaggaaatgccagccgttaagagtgaagtgttggcaactgaccggatcaccaaacgggtacaagtggttcagtcccaaccccatattttagaatttctaccccagggtagtgacaaggcggtgggcataaagcacctcttaaaccactttgggttggattttgcagacctgatggcctttggcgacgccgataacgatgccgggatgctcaaggcggccggtgatggggtggtaatggccaacgggctccccgccgtcaaggcaattgccgaccacgaaacggcttctaacgaggaagacggggtggcacgttacctaaccaagacgtttgcaacaattttgtaatattcagctaaatttgaaggcaaatcgcttcgaaactaaggttctatgatcttttttcgaaagatttgcctttttttaggcttaatttggcaaaccttcaaataaagttaggcaaacttgaaaaccccggccggttagcgattgatatctagtccgttttttcacgaacggcactttgttacaaaagattacaaaatcggcggttgttcgccgccatccgcaactcgcctgaaatcttttagtaacattctccttgtatcattaggaacgtaaatttgagagcacacgtaaacgaaaataaaaggatggttaaatactctatgttaaagaagaacttactgaagatttctgcaacccttggtgcggccgcattaggggtagccgctaccgctagcgttgcgaacgccgacacggtgtacactgttcagtcaggtgacaccctgtccggcatctcccaaaagttcgccaacaacaacagcttggttgattccttagccaagaacaacaacatccaaaacatcaacttgatctacgttggtcaacaattgctgatcaaggacaacggtgaaatcacccaagctacgcaagcacaagcacaaaccttgccgtctgctaacacgactagcaccgcaagttcccaagcaagcacgaacacgcaagcacaagctaccacgccggcaacgagcaccgctgctacgacgaccacgtctagctccgatgacgctgcaaagtcttggatcgccgctcgcgaatctggtggttcctacaccgctcaaaacggtaactactacggtaagtaccaactttcccgtgcttacttaggtggggattactccgctgctaaccaagaacgggttgctgaccaatacgttgcttcccgttacggttcttggagtgccgctaagtccttctggcttgctaacggttggtactaatattaaaataatcataggttaggttatcactacgatgaaccccccggtggaattttccagcgaggggttcattttttgtttaaccgagcggcgccctgaccttggttgttcgacgctagtttagactggtggacgcccacggctagagacggtgctaataagccggctaaggccgcctgggcgtgagtaggagcggtgaaggaaatgaacgtggtcactggtaacagaacgggagggggctttttgaggcccaagaagggcgggctagtaattgtggtgcgccgctaaatcctgtcactggactaccatgatggtaattcgttgacagggttttgcaggtacaaaaaaggggctacgacattgtcgtagccccgaaggtgaaacacatgagctgttttagaaaagcagtttgctcattaggataacgaaggtcaacaggattaccgagctaatcgtggaggcaatcagggcgttacgtccccgggtcaagaggacccggaagttaacgctcatccccagggcggccatcgccatccctaagactaggtaggcgagcttaaccagcatggccaagaccggtgcgccaaggggaacaaaggtcccgatcacggaggctaagataaagccgagcatgaaccacggaattggtaaggagcccttctcgccgttggtggagccggccgccttagcctgcttgcgttggtaccaaagcccaatgatgatcgctgcgggggcgagcaagaggacccgggacaacttggtgataatggcggtgtctaagctgaccggcccaccggcggaaccggcggcaacggcgtgggcgatttcgtggaggctacccccagtcatgaccccgaactgaacggcggtcatgtgtagaaggggcttgaggccaatttcgatcagggtgaagagggtgcctaagatggcgacgatggcgacggcgacgacttcgtcttcacggtcgcgctcttcttggccttccttgctggtgaactgtgatgagatccccattacggcggcggccccacagatcccggtccccgaagcggtcaggatcgctaagtggtcttccaccccaaagcggcgggcgatgttgtaggtgaccaggatggtgcccgtgacgatgaagaccgccagggtgatcgttttaaccccggcctgggctaacgagatcaggttaagcttgaaacccaacaggatgatcccgagccgtaggaatttgttggaaatgaggccgatcccggcttgcgagtagctgattgccggttcgtaagtttgggcgagcatcccgaggatgagcgaaatcaccagggccccaatcacctcaaggtagggaaaaccagcgaggtaagaacccagcagggagcaaataagggtcagcccgaaggcagacgcaaagttacgtgataaaacaacgttcatgtgacgattgatctcctctctcttattacttttttaactttagcatggtatagttataattaaaaatactgaaaagttgtaagttagtaagctttatttataagaaaggagggcgccccgatgaatccgctttacgatcaccggcttttgaccctagcaacactggttgaaactggttctttcacggcgacggccgagcggctcttcattagccaaccggccgtttcccagcagatcaccgccttagaaaacgaattaaacctggagttggtgcaccggcgcggcaagcgaatccaggtcaccaaggcggctgagcacttaaccaactacctgcaccgcgaaagtctaaacgccgaccagctgttggaacagttgcgtggtgcagaaccggtcccgttgaggttgggggcgaccctttccctagcggagttcatgcttcccgagttactaggcgaattggtcgatgccggccaccaggttaagatccacaccgccaacaccgatcaactcctccaggcaattgacgatgggaccatcgacctggccttggtggagggaaacttccataaagaggcgtacggggtactccccctggggacggcggcgtttggcccggtcatggcccaaccgcatggcccgcgcgattgggaagcggcctttaacacccccctttacttacgggaagcgggatccgggacccggatgattttggaagggtggctagcgacccacaattattcggttaatgatttttcccgggtcatcgaagtcgataacccgaccacgatcatcaagctgctcttgcaggggcgggggatctcgtttatgtacctccccctagtggaagggctgcttcgggatggtaagttgcaccggttggacctacctgactttgtggtgaaccacccgttgacgatggtgtaccgcaagaacagcgttgccgagtcccaataccagcaggtggccaaattcttaactagccaccacgaggggagtaagaagaaacatttgggtagggaaagctgagctcttggatgaatggattgatacaaccaaataaaaagctggagcgaccgttgcttaaaacggtcgtctccagcttttttaataagggtgatgtaattaaacggtgctggtggaagcgatcatagttaattccccggtcagggtccacgccgtcacgtcggccggcaagaggaagtggtcgcccttttggagggggtaagcgtccccgtcgacggtgagctgtccctgccccttgatgacggaaaccaaggtgtaggggcgttgggcggttaacgaaagctcaccgctgacttcccacttgtagacggtgaagtaaggcgaaagtggcggggccactagggtggtgatcgttgaggagccgcggtgctcaacgactggtgtcaggtgtggttcttcgaagggaaccgtggtcacgtccgtggcttgttgaagatggagcgcccgtttttgaccagtggtggcgtcaacacgatcgtagtcgtagaggcggtaagtggtgtcggagctctgttgggtttctaggaccacgatccccttgtttaaagcgtggatggtgccacttggaacgtaaacaaaatcgccggttttaacgggccgttttaagaagagttgtccccattcttggtggtcaattaggtcctttaactgtgcccgtgtcttggcggagtggccgtaggtgaggtaggaaccgggttcggcactgatgacgtaccaacactcggtttttcccagctcgtgctcgtgttcggcggcgtattcgtcatcggggtggacttgaaccgacaggctggcttcggcgtctaaaatcttcgttaataaaggaaagacgggggagtggctgttaccgaagagttccgggtggtcacggtaaatatcggggagaagttggccttggtagcggccgttggcaatctggcttggcccgtgggggtgcccagaaatggcccaacactcgccgatcttcccgtccggaagctggtagttaaagtcggttgcgagtcggcgcccgccccagatcttttcgtggaaaacgggagttaagaaaaatggttctgccattggatcacctcattaaagttagaaaacggtatcatacgtcctccagaataagaggtctgcaccaatctgtcaaccaccgggcccagttagccagcggcaaagccgatcattaagcccccctcctcggcgtatagggaacagagcccccggcattggttgatcgtgatctgtgccgttgggtaggtggccgtgatcagggtggctagttgatttgcgccggcgaggttggcaacgtggtcgataattacccggccgccccgaaagccccggtcggttagttggtcgactagtttatttaagacccgcttgcccttgcgcgttttggcgactagttcaaagttaccgtcggcgctggtcgagccaattacgttgatcccgagggcttgggccaatttagccagggcggggttaacccggccgttgttggccaaattgtttaaggactggagcatgaagagtagcttagtgttagcaagggtagcttccgtttgggtaaccacctcttcaaaggtgcgtccctggttgacgagctgggcaatttgttcggccagcagggccattgccggcccggccaccttagaattaaagacgtggatcttcacttcggggtgctcctcttgatagagctcggcggcgtggcgggcggcgttaaaggaaccggacagggctgcggcaatggtaatgacgtatatttcgtcggcgccaacgaaggcttgggtccatgccccggtgctggggcaggccgacccggtcttttctttggaggaaaagagggcggcttgaaaggagggcaagtcaaggtttgtatcgtcaacgtagtggttaccactaacggtgagggtgagggagacggtgacgtggtcaattccgttaatggttggcgtggtcagattggcgccggaatcagtgatgattttaatagtcatttttatacctcgattatctaagcggtttttgaaaaaccttattgacgctattctattatcattcactgatcaatgtcaacggttattcaaaaacttgatttcgggtgtggttgacgaataagtggcgcccttcttataatggtgggagaataaggaggagtaatgatgcgtgatttagagacccagatggccgagtcaattcaaggctttcatttacctcgctacggggagttgccggcggtggggttgtacttagaacaagtaactagcctgatcaatcaactactggcgcccttagaagacgtcaccctaaccagctcaatgatttccaattacgttaagtaccggatgattggccgacccactaaacgcctctaccagcgcgaacaggtggcggaattgatttttatcgccgtggctaagaacgtcttatccttagataacttaaagcgggcgctacgaatccaacgcgataattacgaggtggcggtggcctacgactacttttgcgaggaactagagaacctcctggccgttgtctttggctttaaagaccagcccgacccggttggtaaggaaaacaccgagcaaaaacggatgctagaaaatttgatcaccgccgttagtcaccaggtgtacttggataaatactttgccgccctggaaaatgaggactaaagagggggcgggaagtgacctcggagacaggtcgtttgtaaggttgggtgacggttggcgcactacgcaccatctttcggtttgcttggacaactgatttgcggtcagttaccacgcttgctgtttaacattcggaaagacaatcagagcccaggagaaaacacgtttttctcctgggctctgattgtgtatctgatctgacctggtaagttagttaatgactacttagactactaatattcgtcgtcggcgatcttatccaaggtgtcaattgacgggatgaagaagacctgaccgttgaccggggttgaatagtccaagaggaggtcgtttttggtgaacatgttagttaacatcgtcttggtaacgtcccagtagcgaccgtagccaatgaagtaagtacccgttacgttttcaccagggtcggagaaggggacgttcatccggataatcttgtgttcgacatcgttgcggttgtcttgggaaacaacgttatgagcgcgctggtttttgtcctcgtcgccctgttctaaatcggtgaacttccgccgcccgatgacttgctcctgctgctcagtcgagaggctcttccaggcgtccatttggtggaggtacttctgggcaaaggcgtaagagccgttttcaaattcggggtcttcttcgtgaatgatcccccattcgacggcatcagcgtcgaccgggttttccgttccgtcgacaaacccgatgatcgcccgcccttcaaagtagcggaagccatgggtctcatcaactaccttggtgactggccgcaagaaggtcatgatctcatcaatcacttcgtaggtgagcgactggtcatcggcccggacgtgaaagaagaggtcggccggagttcccggggcgtcgtatttgtcgcccttaatcccggtgaagtcttctaattcctttggcttcggggcctgcgggaagaggtaatcccaggccttgctagaaatcccgcaggcaatccgcaggtgactatcggggtagcgaacgtttaaggagcgcttgatcgcttgcaagcggtctgccgtctcctcaacggcggccttttcattggtttggtcttggcggttcagggaaagcatcaaaaagaggacgttttttccggcgtcacggtatacatcttgggaacgttgtgggttgactgacataagaacccctccttataaatagataaacagtttccacccttagtttagcaccattccagggaaagggttagcgaggggcgataattttggagaaggggtttaaactgtcctcgatcgttaccaaaaaccgctatttttttaaaaaatttaaaggctgattggggcaggagtctagatggtcaaggttgattgaatcggtttacagaacggagtttcggtcacgaatcccttaattggacaagattggtttaggttaatttgacccctttgatggtaaaatctcccccccgaaagcaacacaagtcctgtaaaatatgttaagatatagtgcacttagtaagcgtttacagaaattatagggctttaaaccggaaacgagcgcatacttgctaggtcaaattataaatctgtaaggagagaatgccggccccataatttataccatccggtttataaggcattaggtggcagtagatgtttagtattatcttgatcagccacggtcagatgtcccaggggatccttcactccagtgaaatgatcttcggtaagcaagaagacgttgtggcggtctcattgaatccagatgaggggccggatgacttccgcaagaagttagaagaagccatcgccagtctgggcaataccgaaaagatccttttcttggctgacctttggggcgggacgccatttaatcaggcaagcaacctgattaatgaaaaggaaaagggcggtgactggttaattaccgccggaatgaacctgccgatggtgattgaatcatactcggcacggtttagtggccaagatccaaaggacgtcattaagggcatcgttggtgaggctaagaagggggttaaggtcttcccagaagaattcaacccgcaagaagaaaaaccagccgctttagctaagaaggccggcagcgctaatttaccaactagcggccaaattcaatacgttttggcccggatcgacacccggcttttgcacggtcaggttgccactggttggacgaaggcggccaacccagaccggatcatcgttgtttccgataacgttgccaaagacaagttgcgtaagaacatgatcgcccaggctgcgccgtccggagtaccggccaacacggttccaattaagaagatggccgaagttgccaaggacgttcgttttggtaagaccaaggcaatgctcttgtttgaaacgccagaggacgctttaaaggcgatcgaaagtggggtcgacatcaaggaacttaacgttggttcgatggcctactccaatggtaaggtcaacgttaaccaagtgttagcgatggaccaagaagacgtcgacaccttaaagaaacttcgcgacatgggcgttaagttcgatgttcgtaaggtgccaaacagctccccagaaaacatggacgagttgttaaagaaggcgcagtcattgattgacggtaataaataggatttgaggagagagaaaaatgatctcagttatcttagttatcatcttcgcgttcttagcggggatggaaggggtcttggatgaattccaattccaccaaccactggttgcatgtaccctgatcggattagcgaccggtcacttagtaccatgtatcatgctcgggggatctttacaaatgatcgccttgggttgggccaacattggggccgccgtggcacctgacattgctttggcttccgttgcatctgccattatttttgttcaaggtgggggccaaagtaaggacgttgggactgccattgcgatcgccatcccgctggccgtggctggtttattcttgacgatggtggtacggacgatctccgtggccatctcccacatcatggaccgcgaagccgaaaaggggagcatccgtggggtgaacacttggcaattaatcgccctgtccttacaagggctccggattgcgcttccggcgattgccttaatgtcaattccgtctagcattgttcgtgacttcctgaactccatgccagcatggctgaccgatgggatgaccatcggtggtgggatggtggtggccgttggttacgccatggttatcaacatgatcgccacccgcgaagtttggccattcttcatcattgggttcgtcctcgccgccgtttcccaactgaccctgattgccattggggccttagggctggccttaaccctactttacctacaattggaaagcaagggtggcggtaacggtggttccagcaacggtggtcaatctgccggtgacccgctgggcgacattttggatgattactaaaccgaaattaatcaagaggtattgaattatggttgaagaaaaaattaagttaagcaagcgtgaccgcttcgatgcctgcatgcggtcaaccttcttgcagggttcctggaactacgaacggatgcaaaacggtgggtatgcctacgcaatgtcacctgccatcaagaagttatacaagactaaagaagaccgggcggctgccttgaagcggcacttggaattctttaacacccacccgtacctggcctccccaattatcggggtgaccttggccctagaagaagaaaaggccaacggggttgaagttgacgaccaagccattaccggggtgaaggtcgggatgatgggcccactcgccggggtgggggacccagtcttctggtttactgcgcggccaatcattgccgggttaggggcttccctggccatttccggtaacatcatgggcccaatcctcttcttcgtgatttggaacatcttgcggattgccttcatgtggtacacccaagaatacggctacaagttagggacgcggattactgacgatacttccggtggcctcttacaaaccgttacccgtggggcttccatgatggggatgttcatcctcgggacgctgatcgaacggtgggtttccatcaagttcacgccggtcgtttccaagacgccactgcaaaagggcgcctacattgaatgggataagttgccaaacaacatgcactcggtgcagaaggttctgcaacaatgggacatgggtaaaggcttgtccttgacgagcacgaaggtgacgaccttacaaaacaacttggatcaattgattcctggtttagcagccctgttgctgaccatcttgtgcatgtggttgttgaagaagaacgtttcaccgatcgtgattatcttgggacttttcatcgtcgggatcctcggtcacgttgtggggcttttgtaattgattaacgaacagccctgcttggtgatgccagcgacttcgtttctgtaccaaaactcctacggcaacatcgtgatcggcgatggtggtttcgagtactttgataacaaggaccggcggaagttcattgaaattccgtggtcagaagttgactacgtaatggtgtcggtctttttcaaggggcactggatcccccggattcaagtggtgaccaagaaaaacggtggttacatctttgcggctaaggaacccaagaagctcctcaagttgatgcaagattacgtccccaaggaaaatttcgtcaaaccgcgaccgatgttcaaacgaattagtggctggtttaagcactagcaataagaaaaagtcccgccaagcgctgttgcttggcgggactttttgtttggtggaataaaaaaggggcgccttgcttttaagcaagaccccctacaaagtggagatggcgggattcgaacccgcgtccgagcatatcgccgcttcaacctctacgttcatagatcaactacttaaacttcaccgcaccaaacgccgttaatcaaggctaccagggacggctagcttgcaaaactctttttaagacctcaagcggcaatctcaaacgtagtccactgtagataaaacccggtaccgcaccatggacgagcccggccggatttacgcgcgctacttgttaggcagcgtatgcgtaagattgtgaattattgtttgcagttataatttaaaactgagcgtttttacgaagacgcaaccttcgaaacgcagttggagctcgacctatacccgtcgaatccaaaaacatccccaaatggaataaaataattttaccaagaatcttcgctaaatgcacgtaatctatctttaaatatgaataagttggataagaaaaattgtgttttcgtttttataagtgtcaacttgacaggggatagtaccccgctggggcgacaaccttttgccctagcttagtcatacggcctgtcgagaaggttgaatcgcactcctcttaacattgtgtcccctttcactagtaaactatggtaaattttttagtaaaagtgttgaaagtttagatgaaagcggttaccattacatccgtaagcaattatattttatctgctgaggaggaaatgttagccatggatgctcaaaatactaaggcgaaaacatttagttcccggatcgcatattcgtttggggcctttggtcacgatatgttctacgggatgctttcgacttacttcatgatgttcgttaccggccacttgtttaacagcaacgccggtggggaagccgcccggatggtttcctttatcactttaaccatcatggtgctgcggattgccgaattagtgatcgacccgttcatcgggaacatcatcgacaagaccgacaccaagtggggtcactttaagccatgggttgtcggtggggggatcatctctgccattgccatcgccctcttgttcaccaacttgggcggcttgacttacaagaacccaatgatgtacctggtactctttgccattctctacatcgtgatggatatcttctattccttcaacgacgtggccttctggtccatgattcctgccatctcctttgatagtgcagaacgtgaaaagacggctaccttcgcccgggttggttccaccttagggggccaattggttggggtcgttgttatgccactcgtgctcttcttctcccttaactctaacagcggaaacggggacggccgtggttggtttggcttcgccgctactgtggccatcatcgccgctgtaacgtcaattggggtggggatcttcacccacgaaaagaagaacgaacttcgtaacaacaccgaaagcacctcctttgggaaggttttaggcgtcttagttaaaaacgaccaattaatggcgatcgctttaacctacgtcctctacaccaccgggattcaaatcatgaattccttccaactctactacttcacctacatcatggggaaagcaccaacctacacgatctacgctttgatcaacgggttaatcggggtcatcaccgtttccctcttccctggcttggctaagaagttcagccgacgtcgggtcttcttctactccatcttagtaatgctgatcgggctggtactcttcgccttggccggtcactccttaccaatggttatccttggtggggccatcttcatgctgccacaaccactgatcttcctggttgttttgatgatcatcaccgactccgttgaatacggtcaattaaagcttggtcaccgtgacgaagggttaaccctttccgttcggccactgcttgacaagttcggtggtgccgttgccggtggtgtggttgggatgaccgctaccgctgccgggatgatttccggggctactgctgaccaaatcaccgcccacgggacgtccatcttcaagctgattatgtttgccgttccagccatcctgatcttactggggacctttgtcttctcccgcaaggttaagctggacgaaaagatgcacgcccaaatcgttgacgaactggaaaagacttggcaccaacacctggaaggcgacgactccgcccttagcgaaacggctgccgctgagaccaccgctaccctctcctttgccgctccggttgacgggaagctcttaccattaagtagcgtttccgccccagcctttgctaacggctcgatgggtgaagggattgccatcaagcctaccgatggccaaatctttgctccggtggccgggacgatcgtcgctgacttcccaagcacccgtcacgccctcgggatccggaccgataacgggattccgttcttgatccacgtcggggtcgacacggttgaaatgcaagggactggcttcgtctcctacgtcgaaaacggtcaacacgttgaagccggcgacaagctgatggaattctggtccccagccattaaggaagcgggccacgacgacaccgtcatgatcgccttcaccaagtctgatgacacaccaaactacgagctcaagttcgtgaagaacgaaggcctcgttgatcacggtgacgaaattattcagatcgaaaataagtaatccacctttaaaccggggggccgcgactgtcagcgtcacggtcccccctttttcattaagaaaggaagttcattcatgccagtctttatcaacgaagagaccaagctcttccacttacaaaccaagaacactagctacatcttccaaatcctcgctaacgaggcggcgggacaggtttattacggcgccaaggttccggttaagccttcctattccaacctaatgacgatggaagaacacgactgcaccaacaccctgtcggaagaaaacacttccttccaactcgaactggttaaacaagaatacgccacccagggtaagggggacttccgcgaggccgcctacgttatccaatacccagacggctcccggaccagcgaatttgaataccagggttaccaagtcgaagaggggaaaaagcgcctgccgggtctgccatcttcgtttgacgacgaaggaacggacgccaccagcctgacggtcactttcaaggaccgcctctacgatttgacgatgaacctgcactacacggtctttaacgatgacgacgtaattgttcgctcagctagctttgaaaataagggtgacaccgtcatgatcgatcgggccctgtccgctcaacttgacttgccggacgacaattatgacctcctacaattctccgggacctgggctcgcgaacgtcacttataccgcaaccacctgcggccggggacccaaagcgtggccagtcggcggatcaactccagccaccacgaaaacccggccatcatcttagcccggccaaacaccgataataatcagggtgaagcctttggttttaacctagtttactccgggagtttcttagacacggttgaggttgaccagtttaacaccacccgggtcgttaccgggattcaccccgatgacttctcctggcaactagaagccggccaatccttccagaccccagaagcggttctttcctataccaacgccggcatgaacgccctcagccagcaaatgggccgcttctaccgtgaccacttaattaacccccactttgctaaggaagaccggccaatcctaatcaacaactgggaagccaccttcatggactttaccgaagaaaaactgatgaagatcgtcactaaggctaaggaaaccgggatcgaaatgtttgtcttagatgacggttggttcgggcaccgtgataacgacctgactagcctgggggactggttcgttgaccaaaagaagttcttaaacggggtcggcggctttgccagccgggtgcacaagttggggatgaagtttggcctctggtttgaaccagaaatgatctcaattgactccaagctctacgaagaccaccccgactggatgatccaaactaagggacggctagccaccccggcccgccaccaattcgtcctcgacatggcccgccaagaagtcgtcgatgacatcttcaacaagatgagcgccgtgattaaagacaccaagcttgactacatcaagtgggacatgaaccggacgatcaccgaggccttcaccgctaccctgccggctaatcgccaacaagaatttgcccaccgctacatcctcggggtttaccaactctacgaacgcctaacgcaggccttcccgagcgtcctctttgaatcctgcgcctccggtggtggccgcttcgacctcgggatgatgtactacgccccacaagcctggtgctctgacgacaccgacgccgtggaacggatctacatccaagacgggacctcctacggttacattccgtccatgtggggggcccacgtttcggccgtgccaaacgaccaggtcggccgcgtcacttccctagacacccgggccaaggtggcctacttcggtgcctttggttacgaactggacttaaacgaactgtcagaagaagagcaggaaacggttaaagaacaagtcgccttttacaagcagcaccgccacctcttccaacacgggaccttctaccggattgacagtccagacaccgctaccgataacgtctacggctggcaagtggtcaatgacgaccagtccgaagccatcgccgtgcgcttccagatcctcaatgaacccaacccgggttacatccgcttctactttaccggattagacccggaaaagacctaccaagttaacgacgacgaggaaacttactccggtgcagaactgatgaacgccggttacttcgtggctcggatcatgccacgctcggcctcgccaaagccgctggccgactttaacgccaccatgtttgtggttaaggccgtcgactaagccgctaacttacttacactccttctaaatcaacagcccctcccgagccaggaggggctgttttagtatcgcaaaaataggtggaaaataagattatagatgaaaacggacgaacagttggcgcataagacccggttcttcggtcgtttgtatctgtttcccacacaaaagggccgtgacgaatttgtcacggccctttttgtattgattggcattatgaattggtttcttctggtggcgtactttggcgtagcatcaacctagttccgaccaccacccgctggggagcgagttcgctatcggcgagccgccgtcctagcaattcgatggctacgctcgccatctggtcggtggcaacgtgaaccgccgacagggccggatagaggttacaagtaaccgattcgatatcgttaaaggagaccaaagcaatctggtctggaatgaccacgtgggcctcgtgtaaggcgcgtaaagcccccacggccatcgcatcgttggtaaccatcactgcatcgagggactctgggcccgccaagagctccttcatcgccttgtaaccaccgtcaacggtgtagttttcgaccttaaccagcttggggttataacgctcgcagtccttcaaagcgtttaagaaggtcttttcccgcacgtcgcggacccgctggccgtcggtagttaattcgagaccggcaatcagaccgatgttttggtaatgggtggtcaagtagccggccgcctggttcatcccgccgacaaaatcgggcaagacacagtcgaggccgcccaccaaaacgtcgtagtccaccaccaccacggccggggttagtttttcaaacaagtggagctggtgaccggaaaacttcccgatcgccacgatcccgtcaatatcttggggaatctgatccatgttgttttcaaagacggtcatcgtcatgaagccggcttgctgggccgcctgttcaacgttcatccggacgctcatgtagtagatatcgtcgagttcgcgctcggccgaataccactgaacaatggcgatccgtcgtcccgtcacttgggacttcggtcgcttggtgtaggaaagctgttcggcgatcgaaataattttgcggcgggtttccaccgataccgatagccgcgggtcgttgttgagcacccgggagacggtggccaaggaaacccccgctcggttcgcgatgtctttaagggtaactgccattagttccacctccacgggtcataaatcttatagttgcttaataaatcgttgccagccagcgtcgccttcgtccgtacgcttgaagaccccagcgtcctctaatacatcggagaagacctgggcgagttcttcttctaagaccgcctccacgttggccgacataatgtcgcggcgtgcggcgacctcctgggcccacggcaggtgcgctggggcaatttggttatcttcatttaaccagaatttcttaacttcttccagttcaaccttcagccgggccggcaagattgcccgccccatcacttcaatcaggccaatgttttccttcttgatgtgccacagcttttcgtgcgggtggaagattcctagtgggtactcgtcgctagtgttgttgtcacgtaagacgaggtctaagacaaaggtcttcccttcccggtgcatgatcggggttacggtgtgatgacgggtgccgtcttgcccggtggccacaatcgaaagcgccggatcgctgtagtcgttccaggtcttcatgatgtgggtccccaggttgatgagggcgagctggtcggtcgtttccaggcggatgtctgacattggccagtcaacgatgccggccttgacctgcgggtagtccttaaaggtcagttcctgcttaatcggggccttcatcatcgggaaggtgtggcggccaccttggtagtgctcgtgggccagcattgaacccccgacaattggcaggtcggcgttggagcccacgaagtagtgcggcagggccttttcgatctcgactaagttgaccagggtttgttgatcgatcttcattggctcgtgctggaggtccaagaagatgcagtgttcatggaagtaagcgtacggtgagtactggaagccccaacccttaccgccgatcatcatccgtataacccggtgattactgcgggccgcctggcctaagcgtcctaggtagccctcgttttcaatgcacagggcgcactgggggtactttttggccgtatcgtgggccgccgccgcaatcgccttggggtccttttccggcttggataaattaatggtgatttccagctcgttaccatccttgacctgccgggtaaactcgacgttctttttaatggccgctaccttaacgtagtcgttttcggtacaaagttggtagaaccaaccagtggcggcttccggggaacgttggtattcctgccagaagcgggcgttaacggcggacggcgtgggggtcagcaagtcaaagagctgctcgtttaagatttcccgctcggtttgtccgtcttcaatcttaccgttttcaatcgataagtcaaccagctgctcggcaattgaccgcccggcttgcacgtccccgtcctgatcgccgactaaagcacgcaccttgttggccacgtagaccttgtccaacggttggtaagcaccgcttgcaatcgccttttcggcaaaggtttcaattagtcccatgatctcaaacccttctctcttctctgcttacagcttgtgtggaccgtcaacgatttcggcgtcgtagaaggaggcgtcgtagccgaccttctcacggtagatttcgccaaccttttgcttcaggttttcggcctggtccttcttaacgatggcgatggcggagccggcaaagcccccaccgatcatccgggcgcccaaaacgcctggttgttgccaagcggcttcggctaaagtgtctaattcagtcccggagacttcgtaatcgaagtgcaaggagacgtgggaggcgttgatcagccggcccagcttttcgaggtcgccgtcggtcatcgccttagtggcttggatcgtccgttggttttcaaagacggcgtggcgggtccgcttgagcagggtttcatcgtttaagaggtagctgtattcgtcgaaggtgtcttcgtcgatttcgcccagtgagttgatgtcgagcttggtttgcaggcgctttagggcttcgccacattcagctacccggtcgttgtaagcggaagcggctagggagtgcttcttgttggtcgacatgatcacgatttcgtaatcgcccagttccagcggcatgtacttgtattccagggtgttgcagtcgaggaagatggcgttgtccttcttccccatccccacggcaaactggtccatgatcccggagtttaagccgacaaagtcattttcggtcttttggcccaacttcaccaggttaatttggtcgatgtccaggttaaattcgtcctttaaaacttggcccatcagcatttcgattgaagcggatgaagaaaggccggccccgtacgggaggttcccgtaaacgtagaggttaaaaccgtggtcaatcttaaagcccttttgacgcaggtaaaccaacattcccttgaagtagttagcccacttgcggtcttctgcttcttccggtgcttcgtccgtaatggcaaaggaaaccacgtcgccttccatattaccggagaagagttgcacctggtcgtcatcgcgggcgccgtacacaccgtaagtccccaaggaaattgcacacgggaagacgtgaccaccgttgtagtcggtgtgttctccgatcacgttaatccggcccggggagaagaagaggtcttggccctgcgctgcaaaggtgtcttggtacttgtcaaaaagctcttgttgattcatgtttgtttgccccatttctttgttagtaaaaaacaagtaaaacttttaccattcttatgctactatcacccggtttattagtcaatagagcgcttacattttttaccaatagctaatgaaagcacctaccgccgcaacgtgctatcataggggctaaacgggagggattggatgactaaactttttaccccgactgaggtggctgaaggcagcttgctcctggggcgctggcaattgcaaaatgacgaactctacaccccactcctaggcggagtgattaaaacgatcgtcaccggcagcgaccagctgactttaacggtcgctaaccgccaccacccgcttatgcccagccactactgggcggtgcgggtcaaccacacggcgtggcgccgctatagtgctgctctccctatcgaagtcgccttacccgccgagcgcaacctcgttgagatcatgaccgccggtaataccgacctcgacgacgtctggtccggtaaccaaggctttgccctcaccaagctcgaactgaagggcgccggccggttaattaaaccaagtccccgcccggtcgtagccatctacggcgattcaatcaccgctggctgctgggtcaacggctacggcgccagcagcgactaccgcccggaacaaaactttgtcggcctggcccaggacaaaatcgacgtcgacctcgcccgggttgcctactcggccgccggggtcttgcgcccggctaccgggggtgttccggtcgccatcgactggctcgaccatttcaacgcccagacgccttggccgccccacccggttagtctgtcggtcatcaacctcggggttaacgaccggcgctttagcgaggccgactttgcgaccgcctacgaacaatacgtgaccgcctttttaaagcgccaaactggtccggtcgccctaatgatcccctttgcccagagcatggcaaacgtcatccgggccactgcccagtaccaccagctccccgttatcgaaacggccgattggtgtgcgagtttcaccgatggccttcaccccgacctaaccggtgctcagcaagcggcgccccgctttgccaaggccctcacccgcctactcaatgaaaggatgtgaccaccgtgtctttaaatcgcctgttaccaattgaagccggccacaacttccgcgaactcgggggctaccagaccaccgatggccgccaagttcagtggcaccgcctgatccgggccggcgccctcggccagctttcggaggctgatttagccctcttagcccagctaaacgtgaccgccaacatcgactttcgttcccccactgaattagaggcggccgccgatcgggtcccccacacggccacttatcaccacgaaccggtctttgacaccgaccggaccgagtcatccaagaccaacgccgaactggagcccctcttagtggccgacccggacagcggtgcccgccacatggaggtcacctaccaggagatggttaccgagccgacctctaagacggcctaccaacacttcttcgcccacctactggcgacccctagcgacggggcggtcctctttcactgcaccgccggtaaggaccggaccggggtcggcgccttcttgttgctctcggccctcggcgtcgatgccaagacgatcgaacaagattacctgctgactaaccaggtcaacgaggcctttgtcaacgaactgctgcagcgctttgcttccgccggcaaaaacgagacttacgtccataacttccggtcactagccaccgtttcgccccgctacctcaacgccaccaagcaggccatcgctacccattacggcacggttaacgactttttaaccaccggcctggggctcagtgctggcgacctggccgacctcaaacaactctacctcgtttaatagaaaggaagttttttcatgcacatttccgttcccctgactaaagaagggctcctcgccgatcaatatggtaagttcgccccggccagtgatatgctagccgatcacccggtccgctccttccccattgaaattgcggacgtcccagccggcactgaaagcctggccctgaccttcgtcgattttgattccaccccggtttgtggctttacctggattcactggctagccgctaacttcccggccaacaccaccctaattggcgatgacgctagccgcaaggacggtcacggttttgtccagggcaaaaacagtaacgccggccgcctggttaacggcgacccggccattaccaagggctacgtcggtccccaaccgccggaccagatccacgactacaccctaaccgtttacgccttagacaccaccctcgaccttaatgagggctactggctcaacgagttccgccatgctgccaagggtcacgtcttagaaaaggtcagcctagagctaccgagccgcgctaattaaggaggaatcaccatggataaccggattttcttcaaccccggcgactcgatcgccaacatccacgactacaacgaagccgtccgcaagggccaaatcttcaaaaaggaacagcaggccggcgacctcgtgatcgctaagggtcccgatgacgaagaatacgccatcttctacgccaacgatgccctacccgccgaccacgagcaatcccaaccctacgagattaagaaaaacctctaagcaaaaagagcagccccagacaggctgctctttttacttagttttatcgaattggcaacagcgtagtacgccagtgggagcgacgacgaaatcaaagatttctgtcgccctccccctaaaattccatcgccgccaagaattccttgatccgcggcgttgggtggttaaagaagtcaccggccgacccggtgaagtcaacccggccgtcttcgacaaagacgatcttgtcggccacccggcgggcaaattccatgttgtgagtcaccacaattaaggaatcgccgtcgttggccaactgctggaggacccgcaggacctgggcctctaactcggggtccagggcactagtcggctcgtcaaagaggatgtaggccgggtccattgctaacgcccggcaaatcgaaatccgttgctgctgccccccggataattgacccgggtaacggttggcagtgtcgtctaacccgacttttttcaagagctcgtgggccttttgtttggccttgtccgggtcctgcttgaggacgtgaattggcccctcggtgatgttttgcaggatcgttaggtgcgggaagaggttccagctttgaaagaccatcgccgttttttggcgcaccgctaggatttccttgttagtcaaattggcgccgtaatcaatcgtgacgtcatcgatcgtcagggtgccggattggggccgctccaagaggttcaaggaccgtaaaagcgtcgacttcccggcccccgacggccccaaaataaccgtcgtttggtgttctgcaaagccaaccgtcacgtcatctaaggcgtggtggtcgcggtaggctttatcaacgtgttctaacttaatcatcttattcccccacggcgtccacgtaccgggacgtccacttctctaagtagtgctgcaggatgctcaaaacggtacagaagagggcgtaaatcgcggccacaattgagtacatcaggagcggttggtagttgttagaggcgatctgttggctgaccataaacatttccacgatcgtaatcgaactggccaaggacgtgtccttcaccaaaccgataaaggagttggacagcggcggcagggccacccgcaaggcctggggaaagacaatccgaaacaggacctggcggtaggtcatcccaatcgagtaggccgcgtcccactggctgtccggaatcgacagcagggcaccgcgaatcgtttcggaagcgtaggccccggtgttcaaagaaaaggtaatgatcccagccgtccaggcgttaaactggatgcccacgttaggcaaaccaaagaagacgatgaataactgaaccaagaggggcgttgaccggaataaccagacgtaaaaggaaaagaccgcccgcacaacggcccacacggccttgaactttccctggggttttgaaatccgaatcaaagcggtaatgacggcgatcaccaacccaatcacaaaggagatgatggcgatcggaatcgtgtatttaatccccgcccaaaaaatctccggggtggagcttttaatgatatcccacataagtttcctttctacatgtataaagcaaggggccctagtaaccggcactagccggccaaactagggcccgatgacgacaatttggagacggttagtcccgacttacttatcagtaatgttaccgtggaagtacttttcggacagcttcttgagcgtgccatccttacgtaattcagctaaggccttgttgaccttggtttgcaagcccttgttgttcttggccatcaggaccccaatcttttgaactgggatcttagatgacggaacttcttggtacttgaggtcagttgccccggtggacttttggtagtacaagaaggcttccttagagttcaaggctgcttcggcccgcccttggcgaaccagttccatggccgtggagaagtcggtggatgacaccgtctccccgccgaacttcttcacgttttgggcgttagccgttcccgtggcggcggcaatcttcttgcccttgatgtcatcgatactcttaatcgtggtgttgtcagacttcataatcaatgccgacttggagtaaatgtacggcgttgagaataagtaagacttttggcgttccggcgtcatagcaatgtcgttgatggccacgtcaaacttcttggagccgaccccggcaatcaaggagtcccacttagtcggaacaaacttcaccttgtaacccatcttctttgctaggtcgcgggccagatcaacttcaaacccggttaacttaccgttttcccggtaggagtacggggcgtaggttccttccagcccgaccgtcaacgtccccttggttaccagttggggctcgctagacgatgagctgctcttcccacaggccgctaatgccaccatagcaaccaggctagcagcgaccacactcaatcgtttcatccacttcttcattgtaaagaagcctcctcaatcattttcttcgggttcacttacaaaagtaagcaacttacctttagtaactataacaaggcaagttaggtacgtcaaagaaaaatcgttagaaaattttaatttttgctaatggcttacttaccggccgcccacgatccgttcggcggcgatttccaaacgttcaatcagggcgtcggcattttgctcaaagtcggtgttaaagtcggcaccctctggcgccaccgtccccacttcttcgcccataaaatcggtcacgactagggtttggtcccgccaagctacgtcgtcgtagtggccctctaaggcttcatccataaaggattgcatcaggtccaagacggcggttttaatgacctcatctttagtcaggctagttccccgcacttgggcttgggcgatcttcatcgctacttcttccatgttagttggaatctcaatactcattttgttatccccttcaattgaaatcttcccttcatcatatcataattaggctaagaaaccgttttgattggtcccaatcaaaagctgaaaggatgaatactatgagcgcgaccgtattagttcccacctacctcgccaagacgggctacgaagtcctccaacaggcggggctcaacatcatcgaagttcccaacgtcgataacgccaccctcctcaagtatcaggatgaagcggcgggcgccattatgggtgtgtcaccaattgacgaccaaacctatgcccaaatgaaacagttgaagatcttggcccggatcggggttggtttcgacagcctcaacccggttgaagccgctaagcacggcatcgtggtgaccatcaccccccactccaacgccatttcggtggccgagtcaacaatcggcgccctgttaaacctctccaaggatctcccccaacgaacggccctgatgcgtgccggtaagtggcgggaagctaaccaggcccagggtcacgacatcgacggcaaggtaatcgggattatcggttacggccggatcggtcacgaagttgaaaaacgggccgccgccctcgggatgcgggtgctgattaacaacggtaaccggccgaaagtccctgaaattggggcgccggttgcccttgatgagctactggagaagtctgattacatcaccctgtccacccgggtgacggccaaaactacccacctgattaacgccaccaccctggccaagatgaagggcaccgcgtccatcatcaactttggccgtggcgccttggtcgacaccgacgcgttgattgaggctttaaagaccggggtcattcactcggccgccctcgacgtctttgaagaagagccgctacccaccagctccgaactttacaaactcgataacgtcttactcagtccccacatcggcggtgggaccattgaggcgatggaccggggtagctggggctcggctaccgaggtcgttcgcgtcttggccggccaagaaccccgctgggccgttcgtcgctaaaatggctaagatttactaccaggagatgacgccggcgggctaccgggccatcgaagaacaaatcgaagcactcaaacaaaagcgaccgaccctgatcacccgtctaaaggcggcccgcgccctgggtgacctctcggaaaacaccgagtactcaacggccaaacgggagctgcgccacttagaaagccgcctgcgctacctcgacaagcagctaacctacgccaaggtgattgacgtctcagacgatggcaaggtggccctggggaaagtggtcacgatccgctttttggacgaccaagaagaggcgacctaccaaattgtggggcgccaccaggccgaacaggcttccttaactgaagaggttttggccttcgactcccccctggggctagccctcaaggggcacaccgccggtaccaccgtgaccgtccacgccccagcggccagttaccaagtcaccatcatcaccgtaaaggtgaagtaactttactagccgtcaccaaagaaaatttaaaactccttcaaggcggggcgctccccctttaacccggttaatcacttgattgaccgggctttttttacttgccctcacttccaaagaccgctatactattcaccgttgcgccaaaactttaacacaagatcttgtaaattaggcgactattattaccacatcttgtggttagaaaagagcgattacatgtttgatcagtataaagatgtcttaacccaccttccccagtactccaagaatatcttccgccccggctacttctcctggctagttggccagatgaagaactggagtaccttttcttggtacctggtggcctttaacttcattgtccaagtggtcttaatgatccagggttgggctagcgtacccgtctctcactccatcatcagctttttgtccgccaacctgagcgtattgtgcgtggtcgggatctccaataagtcggccatccagggctggtttggcctcacctcagcggtctttatcgccttaaacgcctacttggcccacaactttgccgacatgaccctgcaaatcttttacatcatcttcttggacctcttttgcattttgtcgccgtcctggaacgataacgtcaaggtccactcgatgggtggcgtcaagggctggctcaagtacctgctcttgttcgtcgtcttatggggtctgatttactacctgtacggcttgattaacgatccccgcctcttcttggactccttaaccttggcaatctctttgacggccgccgtaatggaattcaacctgcttcgccaacagtactacctctggacgcttggcagcatcatcacgatcggcctctggttacaaaccgccctgcaaggtgccgccaactacgccttggtggcttcctacctggtctttttgctaaacgacctgtacgccttcttcggtagccagggttggttcgtgaagcaagaagtcgtcaccggctacagccaaaaggaatccaattaaatagcgggggaaatggcctctagggtgggcctagcctacctaacattcggatacacagcgagggccccggagaaaaccatgttttctctggggccctctttttgggttaattttgctccagcgcccgctggtaagccgcgtaagttcgcgcgtcaaagcacaccatcgtcacccggtcgagctgggaattatttcctaggaaatgttgaatcgtcgcaatggctaagggcgccgcttggtcaagcgggtaggcgtaaaccccggtggaaatggaaggaaaggccaccgtgcgacagccgttggcaaccgctagttggaggctgttgcgataggagttcgctaacaggctggcctcgtgatgatggcccccctgccaaactggccccggggtatggatgataaaggtggccggtaagttaaaacccggcgtgatccgggcctcgccggtcgcgcacccaccaaacttagcacaagccacatctaaacctggtccggccgcccggtgaatcgccccgtcaaccccgcccccgccacgcagggtggtattagcggcgttgacaatcgcatccacctttaacttagtaatgtcaccttgggttacttctattcggcccatttaatcacctaccaaatttgaacccggtcggcgggcgccttgtacatggcgtcgccgtccttgacgtcaaaggcttggtagaagtcagccaggttttgcacctggacgttggcccgcagcttgttcggggcgtgcacgtcaacggacagaagtagttgttggtactgttcgtgggccttcatccgccagatccgggcccagttggtgaagaaggccaccggatcgtaatccgcttcttgcttagcggcggccaaggcgcacgataagcccccggcgtcggcaatgttttcggagacagtcagcttcccgttgacctgttgcccggcaaacggcaggccatcaaattccttaatcatgtcttgggctaggtccttgaagtgggcctggtcctcttcggtccaccagttatttaggttcccaaattcatcaaagagggcgccgttattatcaaaggcgtgtgagatttcgtgggcaatcacggccccgatcccgccgtagttttcgctggccgattgcttgaggctgtagaacggcgcctgcaaaatggcggccgggaagacgatgatgttcataaacgggtggtagtaggcgttaacggtggccgcactcatttcccagcgggtcttatcaacgggctggccaaagcggcggaagttttcggcagccgccaccttgtttaattcatccaacgcccccattaggtttaagccgtcgctaaccttgagttggtcgtaaacggccggcaacttagccgggtaaccaacctgaaccccgaggctgtcgagcttaacgatggccttttgccgggtcgccggggagagccaatcgttttcctctaggcgctgtttgtaaacggcaatcatttggtgaaccatgtgctccacgtctgccttagcggccgggccaaagtaggtttccccgtaatacttaccgattacctggccgaagtagctcatcgtcaggtagtaggcaaacttctcgtggttgacggcttccttggacccggaaagggcgcgggaatattcaccacccaagatccgcaactcatcggtcactaacgaggcgttaccggtgacggtcttggccaacagccagctcttaaagagggcgaagtggtcggtcaaaatttcgtttaaggccgccaggtagttcggttcggtcacgatcaccttggcgggttcggtccccaccaatccgctcaccatcttagctaggtcgagttggtcggtcgccttggtaaagtccgcccaagcgacagggttgtacatcttagcgtaatcagcccgttcttcggccgacttaacgtgaggcactagcagggcgtcgaattgcttcgcttcttcggtgacctggtgggcttcctccgccgagtagcccaccttaacgaacagtttttccaccatttgtgaccacagggccagaagttgcgggccctgcggattatcctcttggtagtaacccttttccggtaagatcaggctgggggcgccaaagaagagcccgtattcggtggcttttttcatgtccgggtcgatgtcaaaggagaccgggctcccctttcccaacagggcccattccggccacttagcggagtaatcggcgtagctggtcagggccgccacttcgtctagttccttgactaagggggccaccccttctgtttcgcgccggtcaaagtccttagctaaggcatacagcttcacggcctcttgcaaccgggcgtttgggacgtccttttgcccagcggccatcgcatttaaatcaccaatcagggtctcttcgacgtctttgaccaggtcgttaaagcccccggtcgccggacggtcggccggaatttgggcggtctgttcccattccccgttcaccgcttcgtacaggtcggcttttaccgcacccttctcaacttgtgtcatcttctcgcatcctttccaagcgtttatgttcattataaccgagcacacaaaaagaggctggaattttatccccagcccctggttagtctctattcataaaattcaacggcctgccgagtaggttggttcccacttctaagataacgtggaacccaaccgcaggcctagtggctaagtacggtcgaagaacactgctcggtgcagtaaccttcaccctagcttagcccaacggcctgccgagtaggttggttcccacttcctacttaacgtttaagatccacataaagccgatgaagatgaagaagagggcgtacatgatcgggtggacttccttcccccgcttagccgcaatcatcgtaattgggtacatgatcaaccctagggccatcccgtcggaaatgctgtaagtcagcggcatccccaccacgatcaggaaggatgggatggcgatctctaagtgactccagttaatttgacgcaggttttgggccattaagaccccgacgatgattaaagccggcgccgttacctggtcggttaccacggccagcagtggcgagaagaacatcccaaagatgaagagaatcccggtcaccacggcggtgaaaccagagcggcccccgacggcaatcccagccgaagattcaacgtaggccccgactggcgaggtccccaacacggaaccggctaacatggccgtcgagtcagacatcagggccttgccgacccggggcatcttgttgtccttcatgaaaccagcttgttgggccaagccgactagggtgccggcggtgtcaaagaaggtcaccaagaggaaggtcaaaaccaccacccacatttgcagggtgttaatttcgccgatgtgggtcaaagcaaccccgaaggttggcttcaggctcggggcggccgatacaatcccgtgtggcacgggaatcaggccggttaccaacccaacaaccgccgtcaccaccatcccgataaagatggctccgggtacccggcgcaccattaagaccgccgttaccactaagccgaccaccgttaaccaagtgctagcggtcgtaaaggaacctaatccaaccacggtggacttgttggcaaccaccaagcccccttggtgtaagccaatgaaggcgataaagaggccgatcccagcggagatggcaaactttaggtcggacggaatcgcgtcgatgatgatttcgcgcagcttaaagattgtgatcaaaacaaagatgatcgaggccacaaaaaccccggccaaggccgtttgccaactgatccccatcccaatgacggcggagtaggcaaagaaggcgttaatcccgagcgccggtgccgtcgcgattgggtagcgggcgaggatccccatcaaaaaacaccccaaggcagaggccaaggcggtggcggtaaagaccgccccggtatccatcttggcggcgccgagaacgttcgggttcacgaagaggatatacgacatcgagataaaggttgtaaaaccggctaaaatctcccgccggtaatcggtccccagctcttcaaagtggaaatacttgctaattgcagacacaattgatcccccattttatagaatgaacgaataaaatcacgatgaatatcatataatattcggctttcaatgtaaaggggcgatccgaactttcttttagtcagcaaagggggctaacagcgccgctttgccccccgcactcaaccagccgccgtggtgggcgactagctgggcgcaggaacgatagtcagccaggttaaccttgccagccacgatcccgtttgcttgtaaccgccgggccaactggacgtcaccagcggtcaccaagtcgttgacgagcgcgttggggcgggtttcccagcccaagttaagcagggcccgggcccgctgatcggctcggtcgtgggtcagggcgtgggctaagtcagttggttgcaacatttcaatcatcctttcttaggtgaaagcagctaccaggcggatcttgcaccgagagcttggcgccggtcgtcaaaagccacaggacgttttggtaggggcgagcatcaagttcttcttctccggcaccatcggtcaaaattagaattggcgtggttgggataacccggcgcacccttaggtcctcaaagatggcggcaaagcgggttcccccacccccaagacgccgcaactgcccaactgccagccgtccctgaatcgccgcatcaaaagcggttaggtggacctgccagccctgttggtggaccagcgccaccaccattttaagcaagcgtgcgacggtggcatcgcccatcgaaccggactgatcgacaaagatttccaccggggtcactaggcggctaacccgtcccggcaagtccatccggtagggttggcggcggttaaagcgggcaaaggaggctcgttgcccgtcaatggcggtccccatcaagcggcgcagggcccgggcccaatcggtttggtagctaccggacgactccgttaatccttggtcttgcccctgaggaaccgtcccacgcccccgctgatcaaagtggggcgcccgtcccttggtgagtcgctttaagcttgccttcattagtaaggggttagcccccgccggcgttacccaggccggggtgggccgctctccacccacccctctccccaccaactgacgcttagtggcgggagctagggcccgggcggccggtaagtaggcggcggaatcggctaggcggggcagccgttgcttggtcgcccgttccaggtcgactagggtgaccgtcccggctggcgactcttctaggtactggttaacggcaacatccgtggcaattgccaccgccgccggatcgaaggcgtcacggtagcggtatgggtggtaccagagcacgtggagggctaagtgatggagtaaattagtcagctcccgtagcggttcctctttaacccaggctgggttgtacgccaagacgaggtcatttgactgccaaatcaggttgagcgtggactgcaaagggtcggaaattcgtttaatgttgactaataccaccccagcgctatggtccttttttaacaggtcaattaccgccgcttgcaactggtgctccccctcaaccattgccggtgccccgcttggcaatttccgccagtaattcatacatagcgcgagccgccttatcatcccgcgcctggtaaagcgccgccagcagatcggcccgcttaccaatttggtagcccgccgccacttgcccatccgcactgagggacttgagaagggtcaccacccgtggcaaagtcgctaggtccagtggcaccgcttgccccagccactggttgaccaggtcgaggcgattactttccggcaggggggccaccatctcggtgaccggagacggggcggataacagttcttcaattcccaccgcgggcgtcaaaataacctgggccaaatcaacccccacttcttcgcctaagtccccagctaagacgtcggccaacaccaccctggattgagcggccgggagtttccttagggacgttaggttgcggctagctcgttcccaagagcgcggcgtcggcgtaatttgcccgaccaccggagccggcgctaagagattcgggtgctctcgcaggtagtcaaccaccactggttgcacccggggggtcccgtcaacttccccttcggcccaagtaagccagtcagttaggttggcccgcatttttaggcgaacggttcggtcacgaacggcggcgtcactgggggtcacggcgtaatcgccggctgcatccatcgttgggtccgggttttgggctagaataatgtgaacctcttcgggcagggtcagggtgtggatctgacgttgcaaaaccaggttcatcaactcactttgcacggcggcgtttccgcggttaaactcgtctaaaaaccaaataattggttgccccgggcgggcttcagcctccttaagtagggtaagcaaagtagttgagtagccgtacttaacgtcggcgagcgtcccaaagcgactggtggtcactaggctgtccttggttaaaggcggtactggtaaggccagatcccccttttcggccaggctaacgacggtggtcaacagggtggcgcccattcgtttagccacctcggctaccaacgcggacttgccgatcccggcttccccaaccaggttaggtacgctcccggcctcaagcagggccggcagggttaccagtagttcttggtaggttaaagacatttcaatccccccatccgtggttaaccaggtcggaatcgcgctttagcatcttggaaacgtaggggttgtggtcgacaaagaagcgcaacggggcgttaccgtggctccccctttggttgacccccacccgggaactgaccccaatcgattggggcgcccgccgcttggttaaatcaatcgaaagcggcgccgtttctagcggctggccatctaagtggcgatccactaaccccagggcctgcccaaccttgccgggcccgttagttaagttcaccccgacctgatgacggcgctcctccattaattcaagcccctccgtgggctctagtgcccgaatcaaaattccctggggttcttcttggtcttgcacgaccacgtcaaagcagtagtgagcccggatttggtagacgtagatcgttcctggcgccccgtacagggcctcggaatagttggtccgccgcccgttgtaggcgtgggaagccgaatcctgctcacccaagtacgcctcggtttcaacaatcaagcccgccactctccccgcggggctttggtaactgagttcacgccccaagaggtccttggcgatctcttcggtggggcgattcgtgaaaaaggcttggtatggtgacatttggtttcctccactgataattaggattatgataagggtacgaacagaaaggacgggatatgatggcattaaaactcgaacggatttacacccaacccgccgacctggacggctaccggattctggttgaccgcctctggccccgcggtatgtcaaaggaaaaggcccacctagacgagtggctaaaagaggttggcccaaccaaggagttgcgccagtggttcaaccacgaaccggccaagttcccggactttaaggctcaatacctagcggaactagccgccaacccagcctttgcaaccctcgagcagaccgtcgccgaccacttaaaggacggcaacgtgatcctcttgtacggggccaaggacccggtccacaaccaagcggtgatcctaaaggaaaagttggaagccggcctcggcctgtaatacgtttattttagcgcgccgctgggaaaagaccaaggaaggtcaaagaagtgcgatccaatctatcaaacaggccttacgactaagctagggtgaaggttggtgccttggcaccgttcttcacccgtacttaagcactaggtctgtggtcattttctacgttatcaaaagtgcgatccaaccattggcaaggccgtgggctaaggaaaggttgggggttgatgcggtacgcaaaaaagagcctaggagaaaagatttctcttagactcttttagtttagtctccattccctaattgctccgcttgcctccccaagcgcaaccgtccagctccccggctgctagcgttaagcggtggtcttgttcttcaatcgtctgtaaggttgctaagagcagggcccgctccccttcatccgtgctcttctccgttagttcgttcacctggtgtttaacccaagccatggttgcttcgtccatttaatcatcccccaacaggtctaagtttaggcgtaagtcactgagttggtcagtattatcttccaagaccgccgctaaccctaggtaacccggtgcccgatcggggtgttgctcagccaacttccgcaggcggcttgctaaccaggccgcctggtcggctaagtgcccgggccggggtgccgtcaggtactggcggtagttaacaaggagttcctggcgctcccgctcagtcaaataagcaaactggcccacgaccagcggggtcaggtaggtcatcttagtttcattggccaacgcctgcagtggacgcagcagctccgctagcgtaaaggactggccctgccccggcgcaaaatccttcagggcccggccagtattgaccaccagcccgagctccttgcccgctagccggtcgccagccgtcccgagcaagtcatcgtcaaagacctcgtctagccaggccttcatcaccgccgggacgctgtaccaatagaggggaaattcaaagatgatccggtcggcagcccaaagcaaggcccgctccgccccacggtcaaagggcgccactaaggggtaccaggtaacccctgcttcttgcttggcggcgtgcttgaaaaaaccttgggtgctcgaagtggctacatccgggtgaccaatcacgactaaggttttcattattaaccctcctctaaaagggtgcgcccttgttcaaccaagcctggggtcgccgtcgtcgtcaaaaagcgctggaggggtacttcctggtggcggtccttaaaggccattggctcggcggccacgatcatcaccagcaggttgttttccgtcagcatcagctggccaatcccggtgtacttaccccgggtgtgcttaccggtccgccagacgtggagcttggcggccccactggcgtcacgctttaattggtagccgccgttaccatcgttttcgaccggcacgcccgtgtaacgcgtaaccgggtattgattcttctttgccatgtttcctcctttggttaaccgtcctccaccccgcttgtattcgcttgcacaaaattattttctgtgctttgataggggcaaaggagtgatcttatgactgaacaagcaattaccgccgcccaaatgcgggccaaggaccaattcacgatcaaccagattgggatcccatccctggtgctaatggaacgggcctcgctcgccgttcgtgacgccattttaacccactacccggcggccaacaagattgttgtcgttgccggtcagggcaacaacgggggcgatgggcttgccattgcccgccttttgcacgttgccgggcggggcgtggccattttaaccattggcaactccgcccacgcttccagcgaacaccaaacccaggcccacatctgcgactactaccaaattccggtcgccagcgacccggcgctgttaaaggacgccgacttaattgtcgacgccatcttcgggatcgggattgaccggccggtcgagggcgcctacgccaccgtaattaagcaggttaacgccgcccacgccccggtggtcgccgttgacgttccctccggcatcaacaccgacaccggcgcggtgatgggcgtcgccgtcaaggcggacctgaccgttacctttgcctacaacaaaaccgggttggtgaccgaccagggccaggcctacgccggtcgggtcatcgtggcagatgacatggggacgtattaaagaagtgcggaccaaccttctcgacagaccgcatgactaagctagagggaaagctgatgcgccccgcatcgttcttcacccgtacttaggcctgtggttggggagcacgttatctgtgttgcagtcaaaaaataaaaaggagttaggggaaaacacggttttctcctaactccttttttactatgcgcgggacttgtaagcaccgtcagacgtgttgacgatgatcttgtcgccgttcttaacgaaggatggcaccgttacgaccaggccagtgttcatcgtagctggcttaccaccaccgtcaatcgtggcccccttgatttccggttgggtttccacgacttctaaggtcaccgtagctggcaattcaaccccgaccagttcgctgtcaacgaagttcatttgtacttgcatgttttccgtcaggtacttcttttcttcgctgatttgggattggtcgatttcgtattgttcgtaagtttccaggtccatgaagacggacgtgttaccttcgtcgtaaaggtattgagcgttcttcttgttaaccatcacttgttccaccttttcagatgggcgcatcgtggtgtgcacaattgagccagaacgaacgtcttggatgtccatttgcatcagggtgttacccttacctggcttgtggtggttgatggcgagcaccttgagcagcttgccgtccttttcaaagaccatacccttcttcaagtcaatcgtttgaatcattgtcttactcctttacctaatagctagattatagtggcgccgcccttgattaaagccggcggccaacttcgctttgccaccgggcgggcccgaacttggcatactttttcattatagcatgcttccctacttcttggcggggattcttattcgccgtttttggcctgttcaatcaggttggcggccgggacccgaatcagggtgtgctcatcggcctccttgttggcccgtagccccagcccgttgatcaagttgttcttgtagcgcaccgtgatcttggcggcaaaggcgcggctcgttgcttggtcttctttgcgcagtttgctttcgttccacgggtaggtcaccgccgcgctagataaaatgtcgttactatcggcgattgatgcgttcatcgccccgaccgtcacctttttggtcgtcgtccagtaagtataggaaacaacgtggtggtcaccgctaccgctgtggttagcccggacgtagtagtagtcattggtgttatcgttggtcagttgcaacgggtcgtatgaataactcaccgttacttgatcagaggttaaggctaccttacgaaacgccgtgaagtaaagcatcgtccccagccaggctaaggccaccaccaacaggaccacgtactttaaaaagagccccttttcaaaacgatgccccgtctttgcgattagcatcaactggtgcacccgaatatagtggatcacaaagcccaagaacactagggctaacaaccacagcaaccatcctagccaattccaactcatcttgtttactccttattatttccattacgttttcaaataaattgtaccacaacccggtacgcccctcggctttgttcaccaagtcggggcaagatttcacataaatttttcgcatctgtcccccaaaacccgtataatggataggaatatgctgatcaaatctgaaggagggcccctgatggctgaaaaatttaacgacctcgccgttgacatcatcaacttcgagcgtgaacaccaaatgattgataacgaaatcgcctacggcagccaattgaccgttgaacgaatccacgatatcaagtcacaagcaagcgtcgcaagcgaagaagaagaaagcttgatccgccgcttcatgcaatcacaaggttaatagttagcaacgtaaaaagggctgagagaagacctctcagccctttttacgttggtcgccggaagcggaccggcactggtgcgggggattcgatcacctgatcggggtgggcgatttgctctagcagggttgcaattagcttgtcggcaagctcttgaaccgggagcaccacggtggctaactccgggtttaagcgttgcatcaaccgggagccgttgtagccggtcacccaaaagtcttcattaattttacgtccgctggcccgtgccatcccctgcaactgaacggccacctcgtcgttaggggcgattaagccgtcatattggtttaagagcagcggttttctgatcagttcgtccaactcgatcaccgcaagggcgttacctcgtctagctaacccatccacgatcccgtcaatccgacaccgggatgacatcggtgagtgagcttcgtccaaaactagggccacctctttggccccttgctccctcaggtaggcggccgccatccgccccccgctgtaagaatccaccgtcaccaccgggatcccctcggctagttggtgggcaaaggaaacgatcggtaccgccaaacgttggtagtgttcgttatccaagttatgggaactagagatgataccgtcgacttggttggctaacaagaccccgaggtgctcttgttctagttggtcgtcggtggcggtggtggcgatgataaccttgtagcccttggtaaagagccgttcttctaggcagttggtcaactcagctaaaaaggggttcgtgacgtttggcaacaccaggccaatgaaatgtgatgactttccctgcatcgcccgggccagggcattgggttggtaatcaagttctcgcatggccaaccgaaccttacgaatggttttgtcacttagcgagtggtagttattgatgacccgcgagaccgttgtcaccgatacccccgcccgcttggcaacgtcctttagtgttgaagtcatgttagctcacccgtttcgtaatcaatttcacgattataacgcaagtaagcggttcttgaaaaccttagacgccgttttggagcgacaaaaaattactaacgctccgtggtctctttgaatcgctcttgattaatcgcccacaaccaccccaatccgttctcaggacggggaccacttcacttatttgccgatctaagaaaagcggttacatgatgattgtgatcacgctatcaatcagagtgtgtgaaattaaaattaattaatttctactactaattaaataccataaatttcattgacctacccccgaaatcatgctagtttaaacatgtattgaatacttaaaaaagtcttatcatttcgccattttagggaaaatgaaatacttatcatactcaaagaagataaatctaaaggagatccggcatatgcacaaaaagcaatcaaatgaccaatacctccactacaaaatgtacaaaagcggtcgcaagtgggtgtttgctggggtcgcagctctgaccctgctaacaacgactgaagtggctcacgctaacaccacgtcttcttcagctgcctccacggtcagcctcaacggttcaaccgttgccagtgaagcggctaaggccaccgttacctttatttcagaaagtaccagcgccactagttctagctcaagcacggctagctcttctagctctgctacctccgctagttctagttccgtggccacggcagctactagcgtaaccagtgccaccagcgctactagcgccacctcggtatcgtcaacgagcgctgacagctccgccagtgccgctacgtctagcgatgacgccagctcctcggccagcgcggcggatgccaacagcggcgtttcctccgctagtgccgccaccagtgctacgtcagcaagctctaccactgtggtccgagcggtggttgccgtggccactagcgctagtgcaagttcttcgtccgttgacctgtcaacgttaaccttctccaacaacgcctcccaacaggccttcatcgaaagcgtagctgaaggggcgatcgaaagttggaacgaatacggcgtcttgccgtcgatcaccgttgcccaggccattctcgaatccggttggggttcatccaccctttccacgcaagcccataacctcttcgggattaaggggagctacaacggtaactacgtcacgatgagcacccgcgaagtgattaatgggcaaagcgtctacgttaacgccgccttccgggcttacgctaacaactccgaatccgttgaagaccacgggaacttcctctactccaactcccgttacagcaacctcttaggtgacactagttacaccgacgtcgcccaaaagctttcccaagacggttacgctaccgacccttactactcttcctctttgatcagcttagttaagacctacgacctgacccaattggacagcatcgccattgcgaacacgccggtgatcaccaacaagagcgattacacccaaaccaacaacggggcatccaccacggcgacggcaacttactacaccgtccaatccggcgacaccctgtccggaatcgccgttgaatacaacacgaccaccgcgacgttgacgagtttaaacaacttatccaacccgaacttgatctacgttgggcaacggctcctggtcaagagcgcatcgactgcagcggcgtcatccgcaacttcaacggccaccagcaccgctagcgcaactagtaccagctccaccactagtgccactacctacacggtcaagtctggtgacaccctcagctcgattgctagctcccacaacacgaccacggcggcgttgacgagcttaaacagcctggccaacccgaacctgatttacgtgggccaagtccttaagttggctaacaccacgacggcaagcacgagttccaccagcagtgccgcttcaactagctcaagcgcaatgacttacacggttaagtccggtgataccctgagttcgatcgccagttcctacaacacgaccacctcgacgttgacgagtttgaacaacttatccaacccgaacttgatctacgtgggccaagtcctcaaggtagccggctcctctaccagtgtttctaccagcactagttctagttcggctagccaagcaacgaccagtggtacctacacggttaaagccggcgataccctcagttcgatcgctagctcctacaacacgactacggcggcgttagctagtgccaacagcatttccaacgccaacttgatctacgtaggccaagtcctcaaggtcactggcacttcttcaagcaccagcaccaccactagttccacttcctcaaccagtggttcttacaccgttaagtccggcgactcgctttccgccattgccgccgctcacggcttaaactggaagacgttagccgccaagaacaacatcgctagcccatacgtgatctacgttggtcaacagttatcgctttaaaattaatttaattatcaacaaaggacccgccaagcatggcgggtcctttgttcgttttggtccccatttttgaaatttaaccctaaaccgcttataatcaaaggcagatttaattccaatgagaggggccgtttttatggtaacaaacgaggctaataccaccattgatgcactagatcaggttagccacctgtttaaactgatgggacatcccaagcgcctccaactgctgtacctattgattcaacaatcgatgaccgtatcccaaattagcgaacgcttaaagtgggaacaatcggccgtctcccaccaactccaagtgttgcgtaagtaccagatcgtggagcgggttaaaaatgggcgccgggttgtttaccgcctggtcgaccccctcgtgatggggatcatcgccgacgtcgtgaatgaaatccgtaaataaaagtgggtaatcaccttctcggcaggtcgtatggctaagctagagcgcaccgttcttcgacttgcttaggcactagccctgcggttattttccacctttgctatctaaccttcgtgaatacagaaaaagaccgactgggtattccagccggccttttttcgttctttttaaaccccagtgacctagtgtccttggttatcggccaaaagttgaccaatcttttgagcgccctgtgcgtcgggggagataattaagagggtatcgttaccagcaatcgtccccactacctctggcatcgacaattcatcaaacatcccgccgaggatggtcgcgtaactcgagtccggggtggttttaacgacgttaacaaactcaacggtggtgtaagagaccacccggttggcaattgcccggtagagccggtcgtcgtcctccttggcggccgccacctgagcatagtaggattgcccatcactgctgctaaccttagcaatgtttagggaatgaatatcccgtgaaacggttgcctgagtggcgacgaccccgtgttgcttcagcaattccaaaagctcctcttgggtagcaatgtgattttcttcgaccagttgttgaattaattggcggcgctgcttgtagttcatacccgatccctccactcgttgaatattcatttatccccttaatattaacccattcaccttgggatacacaaatcattttttaaataaatgacggtttggcggtctttaaaccggtttcataaaatatttacattctacaagtagggagggaagtgcatattttacgccggtgttcctagcggtcgttcttcttttgccatttgcccatcaacgatcgtgtacacctggtcggcgaattcacgcagccgtaggtcatgggtgaccaccaacacggccttgttgtgcttgacggcgaggtcggaaaagagttggcccaccaccttaacccggtcggagtcgagggcggccgttggctcatcggctaagataatttgcgggtcagtgtaaagggcccgggcgatggctacccgctggttttgccccccggacagttcgcccgggtacttgtggatcattttttcgatcccaaggtcttttaacaggtcccctaattcccccttggaaaggttaccgtggcgcatccggtcaaccagggcgaactgatccctcaccgttaagtaagggagcaggttgtaagactgaagaacgaagccgatcttatccaggcgtaaccgatcgcgttgcttaccagacagggctgagatctcttggccgtcaatcaaaacttgtccctcagatggctgctggaggccaccggcgatcgttaaaaaggtggacttccccgagccagacgggccaatcaccaggttaagcttgcccagttcagccttaaagctcacgtcagacaaaacgtgaacccgggcaatcccttgtccgtagtacttttcaacgttacgtaattcgattgcagtcataacgcttcctccttagttcagggcatctagcgggtcaatctttttaatcacccggacgggcaagagggccccaatgacccccatcaccaccagggccaccgctactccaatcgttagcggccagttaaaaagcattggcaccgcggttggtagtaccgccccggtcaccaccgttaataacaaggcaatgatcaccccgaccaccatcaggatcaaggcctgccccaaggtggcgttaatcaggcgttgggctgggattccctgtgcccgtaaaaccgcgtagttggccaatttttgcatcgtcaggatgtataagaagacggcgatgataatcacggaaatcaccatcaaaaagccgatcatgaactcaaagaccgtgttttgagcggaatagcccggcaacttctcaatgaaggtgttgaccgagtaggacgctagacccgccgtcactgccggcttggcttggtcactaatgattccggaagcaacaaactggttaccgaccccgcgcaggctttgccagacgctgaggtccccataggcaatggaagaaatgtttagtttggcatccttagcaaatccgaccaccgtgtactcggtcgctgaattaccaaatttcaccttggacccgagccggtagcccttatccttcaaggattcgtctaaaaccagctggttggacctctgtacccggtgaccactggtaattgctaacttatccttggcgataaactggtcttctttgagccccacgaactgcagggaggtcttgtagctctctttttgaccgaccgtttccatcaccactgggactaagccgagcttggcttcgtgcttggttaacttaggcagttggcttggtgcgatcagggactggctaaggctaacgttggcgtttttatccaaaacgaccgccttggttccccacgattcaatggcgaccgtgttctcactagccaagccaaacatcatccccatcaacaaaaacatcaggtagctagttaagaccaccatcgtcacgatgaggccgtagcgcaccttctcgtgaagaatctctttgattgctagaaacatcttcggtttccccctcttttaaaaggacccgcaagacacgttccaaccgtttcaaaatcaaatcttcgttttccggatccacgaggcactccttgatgctttcgtgaattagcatcatggctgaccaccgttgatcatccatcattgccttaaccttggccggtaagggatcgggtagcaacccctcgttggccgtgtagtgcaaaacaaagaagttacgcaggctgccagacgtgtcagcgaggtcgcgcacccgttggatgtattccgtagccgtctgtaggtgacggcgcttcatatcatcccggctccccagcttggcagccagcaggtggtacatgtaggaataggcgtccgtgagattgtcaaagtacttgtaaaaggccccccgggcaatctgggcatccttaacgatgcgggccacttgggccgttgccagagtgtggttgctgaactcgtttaacagggcggcttcaatccgttgccgtttttcatctggaagattagtaaaggttgaacttggcatcttttcgtccacttctttctcatagtgacaccatgtcactcgattaaggccattctaatcgcgaggtgacaccgtgtcaatttttttaataaaaataggagggtcccgttacggaactctcctaattctactatagatttgcgttaatgccaggggttaggcttcttcgccaccaaccttaacgatcgccttggaaaccttgcctaacttaccggaaacaaagtcttccacctgggtgaattccagttcgtgggagaacagcggcagtgggtccaccttgccactggccaagagggcaattgagtcttcaaaggtgtacgggttgatgaaggccccttgaatggtcaattgcttttggaagacgtcgtaagtgttaacggagaacttgtcgtccgggttcccgaccccaaacatcaggacttgggcgccccgggccgccgcagccaatgcttgttcttgggttgccggggtcccaacggcttccacgacgatgtcaaaggcggcttctggcagttcttctttagtcgtgttgatcgtcttgacgccaaagtgttcgcggttgttggccaatttttcttcggagcgaccagccagggtaacttcgtgaatcccccgagcctttaaaatttgggcgaagagttgtccttcaaacccgtcccctaacaacatgaatacttaaataatcgcttactaaaaagattactgcttggtttaagtagtcttgagagaaatattcattttgaaattggaggcattaaattatactagctttctatataatattagttgtgatagggttcgatacattttttatagtgagcttccagtcaaccattgaatcgttaccatcattttcctcctaattcatcttctgttcgtagcggcgccaagcgtcatcaaagatcagcattgacggtaggtactcggcgttttcttctaagtacttagaaatctcgtcaaaatcttgtgactgcttgggaaaggcggagtcataaaaggcgttattggcaaactgctccacctcatcgggttggttggggtttcgttgggtcatcaaaaagtggtaaaaactttcgcggtacatgggggcctcctatttagttggaatcgtaatcaaaaagcggaaggtgccgttggtcatgttgatttctttggcggtatattgcacggatttatcctggctgtacttatttaaatccagcaggatcgtttcttttttcacgtttaaactaacccactggggcagcttatagttcttctttaaaaaggccatcacaaaccggatcggcaggtttagtcgtccaaccgctaatcccttggcgcgcaacaaaacgttaccctgactagttttttgcgggatgaagttcaaagaaaactgcaccgttgcccccaaaaatttagtccggccaatgacggtcgcgtactttttaccgacgacgaagcggtacttcaccttggagtcctttaagaacttattcaagtagttagccgacagggcgttaacttgcttgcggtttaaggttacctccaccgaggtgtccgcctgtttggtggcactgatctctttgggaacggagaccggggcggtcgttttatcgatcaccaccccaatgaaaatcacgaccaaagtggccaaaatgagaaaggcccacttccacgggttccgttttcttggttgtctgtgcatattctacctcgtttggtactcaaagttgttatttttcaccatcgcgtcaaagagtttctcggtcatcttggtgtaacccaggtgattggggtggaagttatctgacgtcgaaatgtagttgtttaggttatggtccttgttgttcatgattgcaagaaccgccgcttgggtgatctgatcgttattggattttttcgcctgactgaccaattgctggcgggccgcccgggtcgtgtattgaccataagaaagggtgtggttgatgtccacaaaggttgctggttggtacttggcaaccagccgcttagtcaactggttccacttggcaaccgacttggaaatcaccgtcacgttcggaaagtaggtgtaaaaaggattatagatcgagaacacgaaaagctgggcgtttgggttatactttcggacgtctttaaagagggccgtaagcttagtctgataaagcttacccgccgcattcacgtctttttccaccgttaccgaggacgtcgaaaaggcggccttttctaacgtttgcatcaggtcattgcccccaacggtcatcacgatcacgtcggcgctcttgagtccggtttggatttccctttggctatcgagccgggccttaatttgatcggaccggtccccggtgacaccaaagttttcggtggtcacctggttgccatacttatcttccaagcgggtcttaatttgccccacgtaaccaccctgctttttttcatccccctggccgtgggtcaacgagtcccctagggcaaccaagagaattttcttctttaaaatccgttgttgctcttggttggcgacgagggacggttcaccacgcaagtaccaagctgccccaccaccaatggcgatcagggcgacaattaacaacaaccagcgccatactttcttgctcaaaacgcttcctccattaaaaagggacggccgctttggtcgtccccttattttaccggggcggtgagacatcaccgtgcccaccaaaggttagtcgctaaccattgtagcacacttcccggccccgcttaaattaagcgtgaaggtgtttttggacaaattcctcaattggtaaacggaagtcgaggtagttagcctctaattgttcccgtgaccaatcccaccaagcgatcttttctaggtccgccttaatctcgtcggggaagcggtccttgatcttcttggccgagaccccgccgacgatcgtgtagggttccacgtcatgggtgaccacggccccggagccaatcaccgccccgtcgccgaccgttaggcccgcttgaatgatggcaccgtgcccaatccaaacatcgttaccaatcgtggtccggacctgcttgcggttagccaagaactcaacgtcgggctggtcaaagccaaaggtcgtcccgttgtaggcaaagacgtgttgggaagcccggttgtaagggtgattggttggcccaatccgcacctgggcggcaatgctaatgaaacgcttcaagtcgctgttttgcaggtaacaattttgcccggtgtaggtgtagtccccaatcgtgcagttatcggctaacgtccggtcgcctagttccacccactggccaaaggtggtcttgttaacctgggccccttcacccagggttggttcgtctcgctttaactttggaaattcgatgtgcattttagtaattccctcttttcggtttggtttatacttactttataatccatcttaaaggaatgagcaattatgtaccaagtaaaaacaattgataaatttgaattaagcgattttgcccacgatctacttcaaatttctgacacggacgctccgaacgccctgttggttcgtagctcccaggttgacgatgccctgatcaacgaccaactgctggcgatcacccgggccgggattggtaccaataccatcaacgtcaacgcctgcaccgaaaacggcaccgtcgtcttaaacacccccggtgctaacgccaacgccgttaaggaattgatcatccaagctctcttccgttgcgtgcgcccaattgaccgggcgattgcaaccgtcaaagacctgacggccgaaccgggagctgacctccaagtgctggccgaggcgacgcgcaaggaatttatcggccgcgaattatacgggaagacgattgggattttaggcctcggggcaattggccaacgggttgccgaagctagttaccacctcgggatgcaagtcttgggttataaccgtagtcccaagaacctcccccacgtcgttcaactaccgacaattgaagaggtcatgtcattagccgactttgtggttgtcatgctacccctgaccgaagaaaccaccggcctgatcaaccgggaacggctccaacagctaaaaccggacgcctacctcctgaactttggccgtggcgaaatcgttaataaccaagacctcctcgaagcactggccaatggcgagctggccggctacgttagtgactttccagctagcgacctgcaaaaccaaccgggggtcaccctcctccctcacatcggtggcaacaccgaagaggccctgacctttagcaccgatatggccttacaaaacctgcttaacttcttagagaacggtagcgtccggacctccgtcaactttccgcgcgtcgacctcccctttgataccccccaccgaatcaccctcttttacaaggaccgggccaacctgtggctcgatttcgtccaacttttaactgaccagggcttaacggtcaaggaaatgacgagcaacgccaaaaacggctacagttacgccctgatcaacaccgacctcagtgtgctcagccaagcggaaatcgccaacttacgtcaactcttacaagaccacggtgacatcattcgcttccgcttcttaaccaacccatctatgaacccagagctataagctccccttaaatcaacaaaccggccaattacgcaaccaaggttgcgtaattggccggtttttgattggaaagtaggaaataaccgcagacctaatagctaagtaagtcgaatgggttggttaccacccaccgttattccgtgtagtaagtcaggcagcaagcgcccaacccggtatgggtggcgatcacgggcaccgtttcccgcaccgtgacctcgatccccgggaacaactcgtttaattttccctttaagcgggcaacttccttatcggccttgacgtgggaaatcccgatccctttcaccttgggaccattagccatctggtctaagatcttgtcccattctttgtggatggccttaattccccggcccttcatggcgatgtggatttgaccacccgctacttccagcatcaccttaatgtttaacaggctagaaattgtaccggcaaagcgggaaacccggcccccggccaccaggttgtccaggttgtcaatcgccaggtacagcttgtggtggtcaaagacttccttcatcttcgccacggcctcatccatggtcccgccggcttcgattaccttagcggcctctaaaatctggaaggccatcgcccggtcggtggtttgacaatcaatcacccggaccggtgtcttagtcaaactagccgcctgctccgctgcgtgaacggtaccggaaattgattccatcatgcagacacagaggacttcagcgccatcttcgcccagtcgatcaaaggcctcggtgaacttaccgattggcggctgggaggtctttggcaaggagctggccttttccatcatgtcgggaaactggtcgttggtaatcgtttcgcgttcaacgtaaaccgtcccgtcgatcatcacggataaggggatgatcgtgatgtcgtgctctttgatttccgcttcggttaagccggcggaggagtccgccacaattttaatctttgccatggaatttatcactcttcctgaaaaatttggtataattaatctagtctttaaaactagattacgttatcataatatcacaaacttgcgaggagtttgccttcgtaaatcagtataacaaaagttacccttgatttcactgcttctccttgccccaaaggagtccatcatgcatcgtcaacaaccgaatctgttaattgaaattggcaacgccgttacccatgggctgggcgtcggcctgtcaatcgtggggatgatcgccttaatcattaccgccgttaatgcccacagcccgctcaagttagtggcctttattatctacggtaccgttctagtgctcttttacctggcctcgaccctgtttcactcgctgatcttcacccgggcccgccacgtctttcaagtctttgaccactccatgatctaccttttaatcgcgggttcttacaccccttactgcctggtggcgattagagggtggctggggatcagccttttaacggtcatttggttaatggccatcggcggcgttatttacaaggcgctgtggctaaacaaaaagagcttctggtcaacggtcatttacgtgatcatgggctggatgtgcttgtttgccatcatcccactttaccacgccctagggccggttggctttggcttacttttggctggtgggattaccttcacgctgggcgcagttttgtacagctttcccacccaatacacccacttgatctggcacctcttcgttttaggtggcacgatcctgatgtatttttcaattttgctttacgtttaagacccacttttcaaaggtgcaggccgggtccgactcggtcgcttgaagatggcgctcagcgactttttgccaggtgcgatagtcgatgggcgccatttttacgtcgccgtggtggtctccttcaacaaccgttcggtacaagacggtcgctaaagacatggtactggcaaagaggtgggcgcccccaatgatgaagacctcctcgtcttcaccgtaattggctaacaagtcggtcagggcgttgaccccgttaaccagggtgactccttcaattggcgtcgtttgtcgggtcacgacgatgttggtccgcttaggtagcggccgccccaaggacaagtaggtgtttttccccatgatgaccgggtgaccactggtgaggtgtttaaagtgctttaagtcggctgacaggtgccagggcatgtcattgtccttgccaatccagcccgcctcatcttccgcccaaataaaggcaatcttaaccatgctgttcctccttagaccgctaccggggccttaatggcgtcttcgtgttcgtagccctccagcttgatgtcttccatttggtactcgtcaattggcttggcctccgccggcaagatcagctgcggtgcctggtgaactgggcggctgagctgttctttaatctgatcgaggtggtttaagtagatgtgagcgtcccccaaggtgtggacaaattccccaacttccagcccgcactggtgcgcaatcatgtgggtcagtaaggcgtaagaggcgatgttaaacggtacccctaagaagatgtcggcactgcgctggtaaagctggcaagacagcttgccgttgttcacgtaaaactggaacattgtgtggcacggtggcagggccatgttatcgacgtcggccgggttccaagccgttacgatcaaccgccgagaatcgggattggtcttaatctgctcgatcacctttttgatttggtcaaccgggccgtttggcgtttgccaactccgccactgggagccgtacaccaaacctaggttgccgtactgcttagcaaagtcgtcatcctctaagatccgctggcaaaaggcccgcttttcctttttgtactcttcgttaaatgcggcatccaccaaggaacggcggccaaagtcggtcatgtccgggcccgtatactcgtcgctttcgacccacttcttaaaggcccactcgtcccagatgtggtttttgtgttccaagagaaagcggatgttggtgtcgccgcgcaagaaccagaggagctcgcttttgaccagcccaaaggccaccttcttggtcgtcaggatcgggaaaccttcctgcaggttaaagcgcatctggtagccgaagaccgacttagttccggttccggtccggtcccccttttggtcaccgaattccaggacgtggcgcgccaggtctaggtactgttcttcattatgatttaccgtcattgcaatcgctccttttattcaattgggtctaattgtaacagatctcaaccggattaccggcaactctaatccacgtaatcacttaggtattcccagcgggccgtcttatcatcgagctccttagtaacctggtttaactgggcctgtaacttagccagtttctcgtagttatcaccatttgcggccattgccgtttcaatctcttcttgttgactggctaactggtcgatttgttcgttaatcttttcccactccagttgttcggcgtaggtcaacttggttttttcctttttctccgcttgtttggcaaccggctttttctctaccggcgcctttttagccgggaccgtcgtttgaacctgattagctaggtaatcggtaaaacgcccggtgtagcgctcaatttgcccctgccccttgaaaatcaacaggtcgtcggccacccgatccaagaagtagcggtcgtgcgagaccgtgatcacggtaccactaaaatcgtctaggtaatcctctaagacggtcagggtgccgatgtctaggtcattcgtcggttcgtccaagagtaagacgtttggttgttgcatcaggatttttaacaggtagaggcgccgcttttcacccccggataacttccgaattagggtcccgtgcatgaagcgggggaacaagaagcgttccagtaacttcgtcacgtcaacgcgctgaccgtacttatcgaccacgttgtcggcaatttcggttaaataagagatcacccgtttatcgtcgtcgaccccctcggtttgctgggtgtaataacctaggttaacggtctcgccaatctttaagaccccggaagccagcggaacccgccccgcgatgacattgaggaggctggttttcccggccccgttttcaccggtgatcccaatccgatcgccaccctgaaccagcaggttgaagtcctgtaagatgtggtgttcgccaagggacaggttggcgccctttagttcgatgacgtccttcccgagccgttgtgaacccaggtcaatggcgatgtcctcgtccgtttccacctggcccagggagtccttgagctcgttaaagcggttgatccgccccttttgcttggtggaacgagccttggcgccgtggcgcatccaagccagttcctttctgtacaggttttgcttcttgcgttcactagcctgggagagttcgaggcgttcggccttcttttcgacgaaggcttggtagttaccgtcgtagtggtgcatgaccccgtaggccaattcccaaatgtggttagtaacttgatccaagaagtaacggtcgtgggtgaccaccaaaacagcccccttgtacgaggctaggtattcttggagccacacgattgaggccaggtccaggtggttggtcggttcatcaagcatcaggaggtccggttcttgaatcaggacctgcgctaggccaacccgtttcacttgtccccccgacagttcccccatcttctggtccatgtcggtgattttaagttgggtcaggatcgtcttaatccgggaatccgcgtcccacgcgtcctcttggtccatggacgcttgcagcttggcaaagcgatcggccgccgccgcatcttcggggtggttagtgtactccgtgagggccgcttcatagctgcgaattgtttgaaagacccgctggctgcccgcaaaaaccgcatcggtaatcgataaatccgggtcaaaactcggctgctgcatcaggtagccaatcgtgtagtcccccggcttagtgatctggccggcatcggcaccggtttgaccggcaatcacattcaagaggctggtcttcccactaccgttagtaccgatcaggccgatccgatcgccctcgttaatcaaaaaggacacgtcttcaaagagcaccttttcgccgtaatgactcgttaaattatccgcacgtaatgtctgcatgtttcctccttactacgcctttaacagctcgcccgccgcctttaatagggtctggtaatcattggccagctgaccttcaaccacttgtttagtcagggtggtgagggccttgcccattgctggccccggcttaacccccgctttaattaggtcgcccccgtttaaggccaattcgccgctctccttaattggtagagcctggtacgctgcttgaaccgcctgtggatcgacctgaccacccagggagttggcgatcacgacggcgtctgccaccgcttgctgacccgcctggtaaagatcgcttgccccagccgtcttagtcgtcagtttttccaccagtggaacggcccgagaaacggcggtaatcaaaccattcgatagcttccacccctttaagaaggggcgcagctggtttttatcaaggcccaagcagattgcaagtgctccccaagcctgcgtggcgttgtttaacgtcagtggttgctgagccaaatattggagcccttggccaccctccttcagtcctggacaatgcaggtacagcttggtgtctaacatggtagccaaaccgttttggaccgccttaccaaggagtaacttttcgaattcgacctggatccgttcaacggcgatcttttccaacagggccgcgttttgtgacatcccggccagcgtgcccggctcgatttgaaaaccaagcttggcggcaaaccgggctgcccgcatcattcgcaaggcatcctcgtgaaaccgctcggccggatcaccaaccgccttgatcaagtggcgctttaaatcccctaacccgtcaaaaaggtccaccaccgtcccgtcctcttttaaagccaaggcgttaatcgtaaaatcccggcgctgtaagtcttcttttaaagaccgcacgaaggtaacggaatccggacgccggaaatcttggtaacccgactcggtccggaaggtggtcgtctcataaccagtcccgtgatctaaaatcatcaccgtcccgtgttcaatcccggtgtctaccgtccgcgaaaagatctgtttgatctccgccgggtaggccgaggtggcgatgtcaatgtcatgaatgggtaagtttaaaatcgtatcgcgaacacagccgccgacaaagtatgcctcaaagccagcttcttcaatgcgcgaaaggattgggcgggccggttcaaattccgccggcagcgtctcaattttcatggtgaagccccgtttcgtccaaatttaaggtgcggacaattactacttgctcggcacccaattaatctattctagcaaattttggctggtcgtgttagggtgttggcgatttgtttgagtgggtgtatagttatagtaaatatctgcttacttggaggtgttcttatggcagaccattacccctaccaacaaccgtttgaaaattttttaatccaacagggactggcgccgctgacggtggcaacttatgccaccagcctcaccagcttctttgacttcttgcgtgctaaccgccccgcctttgcccacgacccccaggtggacgcggtcaccgaaaccgacgtccgggccttttttaactacctcaaagacgaccggacggcgacgctggcgaccaccaataagattttatcccacctcaaccgttactttcgctacctcttcactcaccaactgatccatggttacccgaccctgaccctgcacggggccctcccccgcccggcggtgaaggtcagccccaagtgggttaaccaactcgaccaattattggaaagtgaccaactccacttctacacccgtttaaccctattcctctcggctaaaggctacacggttggcgaattcttggcccccgactttggccaacaactgcggcgactgagccccactactaaggccgagaagaactttttagtcgcctttaacgttttccaccaacccctcgcggacctgcaggggtgcacggatccctttttaaaaacccggcttaaccacaatcagccacgccttaccaacgccggtttgcacaagtacctcaaggccgacgagtcgttaaccaacttctcgctggccccccgtaacctccaccagggttacgtcttaaaccaactccgcctccaccgggactggtcggaccagcaattaatggaggtcctgcgcattgacccggcctccttgctctactaccgccggctcttgtttaatcaagacagggcggaacaatcggcggaaaaagactagggtgattggccactaacgtttggaaatacaagcagagcccaagaggaagcggcgctttctcttgggctctgctctgctttatgccccgtttctcacgggtttccgttatctggttagtagtcttcgtccagttgttctaggagttcttgtagttcgctatcggccggatcaatcgccaggtagtgctcaacggcctcccgcaactgcgggcgcatccccatttcctggtaaaactcaatcaactgacgcaagaaggttgggttatcactcagggccggggcggccgcttcaaaagcttgcttggccccgtcaaagtcctctttgtgcaagtacgattgggccagattccactcaacttggggatcatcgttttcgtccaccagcggtgccaagagggcgaggttctcgtcgtcttgaccttggtgaagcaagaagttggaatactggagggtaatggtttggttatccggatccagttcgtgggcccgcttcaagtaggtcgccattaattccgtatcgccaacgtggctagccatctcagctgcttgggcgtacaggtgctcattgtactggtcaaccgccaatccttcttgcagggtggtcagggcctgggcgtagtggtgctcttcggcgtacgcttgggccagggccgggtagaccgaggcgtattggccatcgtcttctgctagctccttgaaggtaatgatggcctccttgagctggtggagggctaactgagtcaacccggtctgaaaccggatgtcactggtttgataaccaggcgctacctgatttaagtaacccagtgcctgatcaaacttaccgagctgggcgtaagcggtccccaaccgtccggcaatgtcaaccttcgcgaattcgaggtggcccgccttaatcagggcgaagtaaaagggaatggcctcttggaacttaccgattaggtagtagtactcggccagggcaaacaagacggcgggttcgtcgggcgccatccggtaggcctcgtttaacttggcctccgtaatttcaaattgctcctcggtttggtagaggtcggcttgcaccagcagcgactgcaggtaagccggcgagctgggttgaatttgggataggtaggaaagggcctcgtcattgtcgccattgtcgatggcaatttcggctaaggcggttcgtaactcatcctcttgtgggtagcggtccaaaagctttaaataggttcgctgggcctggttggtcaacccgagtgcgtaaagctcttccgccaagctgtagagggtgtcatcgtcatccttccgcagggcccaggcgaagtctttttgggcctggtccatggtaccttcttcaatgtggtctaacatttgttctgaataggtcacgttgttacccctttctaattgaccttaaaaggggctgtgacgtacttgtcacagcccctcgtttacgctaagtaaagcttacttaacggcgtccttaagcgcctttcctggcttgaatgccggaaccttgcttgcaggaatttggatttcttgaccagtttgtgggttacgacccttgcgggcagcacgttcacgaacttcgaagttaccaaagccgatcagttgaaccttttcacccttagccaaggaagcttggatggagctgaaaactgcgtcaacagctgcggttgcatccttcttagtcagaccggttgcagttgcaacgttggtaactaattctgccttgtttgccatgtcactttcacctcccactaacgatcactccacggggggtgatccagtgattgttaattttgagtggtccaaaattaacgaaacaatgacgaaccttcgcattatttcaaaaactagattagcatagtaaaaccccgttagcaaggcatttcccggggtttttaccatttttgccattttccgggaaatttccaccctcaatccttgcgcaagcggtttcttcctacttgcgccggcgtttgattaagcgaattggggtcccggtaaagtcaaaggccgcccggatccgattctctaagtagcgggcatatgaaaagtgcatcaggtccggatcgttaacgaagatcacgaaggtcggcggcgccacggcaacctgagttgcgtagtaaacccgcaggcgccggccgttggacgatggggttgggttagcggccagggcatccatcaagacgtcgtttaagaccgccgattgaatccgccggttttggtgatcgtaggcctcttcaatcatctccggtaaacgggacagccgttgcttggtcttagccgacacaaacacgatcggggcgtaactaaggtactggaattcgtgacggatcaggttggtaaagtcggtcatcgtccgttggtcccggtccgggatcgtgtcccacttattgacgacgatgatcaccgcccgtcccgcctcgtgagcgtagccggcaatgtgcttatcgagttcccggatcccctcttcggcgtttaacacgactaagacgacgtcggagtcatcgatcgcccgcattgagcgcattagggcgtaacgctcggtattttcgtagagtttgcccttctttttgatccccgccgtgtcgaccatcgtgaattcgcgaccgtccttcgccgtaaactgggtgttaatcgcatcacgggtcgtcccggccatgtccgaaacgatcacccggttttcgcctaggatggcgttaacgagcgaggacttaccgacgttgggccgcccgataaaggaaaagcgaatccggtcgtcctcttcttcggcgtccttttcggcaaagttttcaatcacggcgtcgagcatatcaccaaggccaaccccgtgaacggacgaaaccgggtacggttcacctaaaccaagttggtaaaagtcataaacgtcgagccgccgctcggggttatcaaccttattgacggccaagacgaccggcttgttggaccggtagagaatttgggccacctgctcgtcggcatcggtcaccccgttttcaacgttaacgaccatgatgatcacatcggcttcttcaatcgcgatttcagcctgttgccggatctgcgttaagaggggttgatcggacatttcaatccccccggtgtcaatcatcgaaaagtttttgcccagccattccccgtgggcgtagaggcgatcccgggttactccgggggtgtcttcaacgattgcgatccgctccccggcgatccggttaaagagggtcgacttccccacgttcgggcgtccgacaatcgctactactggatttgccatgaagtttcctcccttcaataaattttggcaaaaacaaagccgggattactcccggccctgcttattgatggttatgattacttgtcgaagttcttcaattggtcaccaagcaggtcacccaagttgaaaccactttcttcttccggtgcgtctgcgatgtagttgttgttacgacgacgcggacgacgggaaccaccgttgttgttattgttgttgtcactgcccgccggagcttcttcaagcgccttgatggacagacccaaacgttgacgttcagggtcaacgtttaagaccttcaccttaacttcttgccctgcttcaagcacgtcagctggcgtagcaatgtgcttgtgggagatttgggaaatgtgtaccaaaccttcaacgccagggaagacttccacaaaggcaccaaagctagtcagacgcttaaccgtcccagtcaggacagtaccaacggcagccttttcttcgatgtcatcccatgggccaggcaaggtttgcttgatcgaaagggaaatccgttcgcgttctgggtcaacgtttaagaccttcaccttaacttcttgaccaacttccagaacgtcggctggcttgtcaacgtggtcgtaagaaatttcggaaacgtgaactaacccgtcaacaccgccaaggtcgatgaaggccccgaagttagtcatccgggcaaccttaccttcaaccacgtcaccagcagccaattcagagaagatcttcttggcagcttcttcgtgttgtgcttgaacgatttccttgtgggaaaggatcaggcggttttcacttggttcgatttcaatgatcttgaattcaagttcttcgcccttgaattggttcagatcttcaacgtagtggtcagtaatcattgaggccggaacgaacccacggacgccggcgtcaacaaccaatccacccttaacggcttgcgtaaccgtagcggtgatggtttcgccatcgtcaaacttcttttggatttcgttccaaaccttcatggcttctaagcgccgatgagaaagcaggtaagaaccattttccttgtcgctcccgatcttggagataacaaccaggtcaagttcgtcaccaaccttgacaacatcattgatgttgtcaacgggcttggtagacagttggttggctgggacaaccccttccacaccagagtcttcgatcccaacgatcgcttggcggtcgtcgtcgatttgtaataccctccccttaacaacatcaccgacgtttaccgtcttgatggagtcaagtgcttctaacatagcgttattgttttcgttttcagccatctaaaaatatcctccttgcaacaatcaactctaaacaccattttacaggatccgaactgacattgctagtcttttactatttttgttccagtgttttttcaattcgaccggcaatctgatcgaccacttgctcaatggtcaggtgagtggtgtcgagttgataggcgtccgcggctttaacgagcggagaaaccgcccgggtggaatccttttgatcccgtagttcgatcgcccgttggagttcttcaattgaaccaccgtcgatcccccgctcttggttatccaagaagcggcgccgggcccgttcgtgtgccgaggccaccataaagattttgaccggggcatccgggaggacggtcgtcccaatgtcacggccgtccatcacgatcccgccctcttgggcaatttgacgttgcaattccaccatccggctccgcacggctggaatggcggccaccgtcgaaacgtgctgagccacttccgtcgaccgaatcgcctgggtaacctcatgcccgtcgatgaagaccttttgtgggtcgccgggggcgaaggtgatcgtgatttggttagccagttcactcaccaagtcatcttggcttaaatcaattccccgctctaaagcggccagggttaccgaccggtacatcgccccggtgtcacagtaaatgtacccgaagcgcttggccacgagcttggcgaccgtactctttcccgccgaagccggcccgtcaattgcaacttgaattccctttaccatataaaaatgttcactcctaaatattacttaacccgcaaccgttcaccgggatgaattgccgtggtagtggtgatgccgtttaaagaggctaactcagccaccgttaagccattatccttggccacccggtaaatcccttgtccggactcaacagttgtgtaaacagccgtcgttgacgaactgctagcactcgaagaacttgccaacgcggatgaactagaggtgctggccgccttacttacagaagaactgctactggcctgtttccccttactcacgctagctgatgaactggttgagctggctttttttttagacgttgctgtcgaagatgacgccaccttcaccgttcgttgcgggtgattaaatgactgctggtggttaacccagtataaaaccggggtcgccgccaaaataatgatcaagacgattaaaatcgtggtgatttgggcgttgtgcgtactttgcttgcggtgtgccatccgcgataggtgcccttctttatcgatgtcttggttatcggtaaaggtcttatcccagagcttttcgttccgttgatcttcccggcgttgagccatgtgccacacccccttaagtagatttcatcaacgattgtagcgcatcaaagcgccgtgtgtctagcccaacccctgtcggttgaacaaagttgcgacccggtttcgccaatcgaggacggacgaagccactcgccgtttgaccgcgggcagttgcaaagcggtcaccgtccagtcccggttggtcaggtcacaacaccactcgacctccgcctccagacttgcttggccaaagtaggctagtaaattagttcgccggcacttgtcttcctcgacgtaacttaacatccgttgcacctggcggccccgcttttgttctaggtccgcaaaaaagcgccacaccgcctgcccgtccattccctggtccaggtagtaggtgaccacgcgcttagcctcccctaaaagatcggccttcaccttgcccgccttgatttgatctaagacggcggggcttggtaaatcgacgtggtttaacaagagtggcaactgctcatcaccgtgacaatataagagcacggctaaggactggcggccatctctaccagcccgaccaatctcttggacgtacgcttctaaactccccggcatctgaaagtggatcacgtaacggatgtcttgtttatcaatccccatcccaaaggccgacgtggccaccactaggtccaattctccacctaagaactgctgctgaattcggtagcggtcaacggggtcaaccccggcgtggtaagccgccacccgtaagttggcttgttgatttaaccagtccgccaattggttggccccctcacggctggagaggtagaccaccccactaggccctaactggttgaccagttcgagaaggcggcgccgcttttcgtcttggtcagctagtttttggacggccaggaaaatattggggcgattaaccgatttaacgacccgcaccaccgcggccggattaaggcctagacgctgaatgatatcatcttggattgcgggggtagccgtagccgtcagcatcaatagccgcgcggggttgaccgcttgaatggcctgggcaacccggaggtattccggacgaaaatcagggccccactgggaaacgcagtgggcctcatcgacgacaaacaggctaatcggttgacggtgcaacgcccttaatacggcgggcttgagcaaggtctccggggaggtaaacaaaaacttaagctcccctaggtggctcagcacccactgttgctcttggtaatcgaggctagaattgaggctcgccaccggccctaagccatcgctacgcaggcgatcaacttgatcttgcatcaaggaaatcaggggggcgatgaccaccaccaagccgtctaacattacccccgggagttggtaaagaagggttttgccggccccggttggcaagacggccagggttggcttccccgccaacgtcgcttcaatcgtctccctttgtccgggacgaaagtcagcgaaaccgaaaaaacgtttcagtgcggtgcggacttgttgttcatcaatggtcactgttttgacacctcatgatttggtacaagcgaaacaagaaaaactcctggtttaagtccaggtccgggtgggccgccacgaactgccaactcgccaccggtccttgatagcgatttgccaactcttctagcatcccggccggaaagagggtgcgccagtccgccatcccgggggtcaaaatggcggcggttaacaggtgatcacggatcgtcgacaatttacggtggcgacgacgactaattgccacggggctttgaccggtcaaaaaatcagcgaccgtctgctgggcgctggtcgtcaacgggctgttagaaattaggggacccaccaactgactgagcggcccgggagtggtggctaagtaggctcctaaccctagccaggcgtcatggataatgatcgccgtttcgccctcactcacccggagctcacgcgctaactgaccaagcgttgccccgctggtctggtgaccgattaacagggccgctagcacctggggcaagcggggatccactttttctagggcagcaaaggcggcggtaacctgctgttcaacggccccttggatcccccgcccactcttgaggagccactgcttaacggttcccagctcgtagttaccaaggtttaagggacggtagcgacgattatggtgggcaaactcggaaaccacttgaatccccaataggagccggttggccaagcgttccgggttaattcgccacccccagttaccgaaacggggttggtagtgttcagtcaataagcgttgcttttcgactaaccccgcggtggtcaaccaggcctggccttcttcttgcaccattagccccgccgtgacctgctggttcatccatttgtcaaactccgcccgctttaactgacgttgaccggcgacggcctcctgaattccgtagaccatcgcccagaacatcgtcgcctctgacaaacggttttttaacaggttttcaattactcgaaaccgccgcggttcctgatcaaataaaaccaaccagtaatcgttcactgctagccccccttttacacttagcatacggtgttttgccaagcctgacaagcacctataaacagcccttaccataagaaaaaggaccaggagaaaagacgtttttctcccaacccctgactggattcataaatattggacggaaagtgacctcagacctaagtctaggtacggtctttttcgagggtcatttcccactccctagtgattttcaaatgcgctccaattaacggtctaaccgggcggccacccaatcccgcaggctccaagccaagaaaccaaagatcaagctcaacaagattcccttaatcaggttgaagggcaccaccccgattgctactagctctggcagtggtaagcttggtttccacccccacagggccatgtaggccggcgttaaaacaaagtagtttaataaagacattaccaccgttagggctaccgttgcccataggccaccaaagaagaggcgccgcttcaaacttcccttgccccggcgaaggaaccaagcaaacggcaacaagagcgacattgacgacagcaggttggacaaaacacccagtagctcgccaaccgacatcccgtacatcaaaccgtgcaagaggcacttgatggccgccacgatgatcccggccaccggaccgtagagccaagtggcgatcaaaaccggcaggtcggaaaagtccattttcaaatacgacacaaccggaatgaccgggaactcaaacagcattaagacaaaggccaaggcactcatgcatgccaagacggctaggcgctgaacgcgggtatgggtaagagacatagtataacctccaagaggtcatcttcttggtttcaaccactaccacgaaaaaaccggggacaccatcagggcgtctcccggttgaaacatcgttgtgatgatcttctacataccagactttactgtcggcacccggaatttcaccgggttccaccgcgtgtgcgggttgcgggctataccgccggtcgggaattacaccctgccttgaagacaaacctattaatttatttaattcttaaccattataacccacccagctctgtatttcaaattaatacaacttgcgtagggcccgcacctcatcgaccttgagcttacggaactggcctggattgagcccagctagagtcagcggtccataactttcccggtgcaacttaagcacggggtggccgaccgcttccatcatctttttaacctgatggtagtgaccctcgtgaatggttaacttaaccaccgaggtcttttggcgttggtttgcttcgagtagtttggtccgggccggttggctctttttgccatcaattttaaccccttcgcggagcagccgcatctcatcgtttgaaacgaggcctttgaccttggcgatgtagaccttatcgacttcaaagcgggggtgcattaaccggttggctaattccccgtcgttagtcatcaccaagaggccggtggtgtcgtaatcgaggcgccccaccgggtagacccgcgtttgcaccccttcgttttttaagatatcgaccaccgtcttgcgccccttatcatcgtgggccgaagaaatgaccccgcgtggcttatcgagcaaatagtactcgtgttgctcttgttcgaccggttcgccgttgaccatcacctcatcgttgccatcaactttggtccccagctcggttactacctggccattgaccttcaccttgccggcgagaattaggccctccgcagcccttctggaggcaaccccggcgtgggcgatcaccttttgcagacgttcttttgccatctattcgttttcctttccttcttcagttcgtgattgtagcgcccgtaagaagacgtccccgtccaggtcgtcttcggtcaagtcggtttgcaacggtggcaggtccgctaacgactgcaggccaaaatagtccaaaaaggccggggttgtgacgtacctgaaggggcggccgggtacttcgagccggccgtgggtctggaccagtccccgcaccacgagtttttgaagcgaccccgagctttgcacgccacggatgtcgtcgatttccaagcgggttagtggctgcttgtaggcgacaatggccaagacctccaagacggcttgcgacagtggggtggttagtggaacctcaaagtaagttttcataaccggcgccagttccgctttggtggccaaacgaaagacctccccgctattaagcagggttaaagcggtctgggggtcggcctggtacttttcttgtaggcgcgttaatagttcgttgacggctggtttcataaacccggtgatccgggccaggtcagcaacactgatcccctcgtcaccagcgatgaagagcaagccctcaatttgtgcgatattctccattttggtattcctcgtttcgtgggcccggcattacaatcagcgggccgaagcgttcagattgggccaaggcaatcacctggtgtttagtcaggtccaagaccgccaagaaggtcgttaccagactgtctttggtccaatcattttcaaacaggtcctcaaagcgggttggcttgttcaccacggtaatcacgtgttcaatccgctcggcaaccgtcaccgggtcgggatcgacggtttgggtaatcggttcgtgaaagtggtggcgcttgaccacgtcttcaaaggcccgttgtaactcttcaatgccaacccccggggcaaagcgggtctctaccaggttctttggcaccgccattgcttctctggtgtactcccgctgccggtattcttctttatcctttagggccgccgctgcctttttgtagcgttggtactctaaaagttgcgccaccaattccgcccggggatcctcttcttcaggtggtagctcatcttcaaccaccggggggctcggtaatagcatcgcactcttgattgacattaaggtcgccgccatcacaaagtactccccggcgatgttgagctggttttgctcctgttggtgcaaaaattcaacgtactggttggtaatcttggcgattggaatgtcgtagatgtcgacttcggcctttttgatcaggtgtaacaagaggtctagcggcccctcaaagtcacctaaaaccagcgtcggttgccccaccaagcgggccagttcttgttcagccatttaaatcccctccctggcggtagtagcgatcacgggcccagttggtcactaccccctgggtggtcaaggttcccataatccgtttttgggggtacctctcctgcagggccgctagcaaggcaaacacgtttttgcccgcccggtcactgggcgtaaaggaaaggtgccggactaacacgtagtcttggccaacggaaaccacgacgatcccggtgaattggccaatcgtttcgttttgccacaggtaaatcagctgatcggactcccccgaccagtcaatcgccgcttttagccggtggtaatccttaaaggggggcaacagtgacagtaaccccatcgcaatcttttggtagtccttacggtaagcgatcagcatggtgcccctcctttgcttgctctaagtacacttgggtcgtcaggatgctttggtgccccatcagttgctgaacaaggcttaaatcagcaccgtgggctagcaggcggtaggcaaagccatcccggacccgctggggggttacggccccctcaatgttggcccgctgcccagttgcgttcacaatctcccagattgactggcgcgataggggctggccccggttatttaaaaagacgtatccctcatcggtcgccgactggtcggccctggcggttaagtaggtcgtcaagtacgtttgggcctgttcgttgagcgggaccaagcgccgggaggactgccccaggtagacgacccccagttccaggtcgaggtcacccgtttgcaggtcccgaagttcgttagcccgcgccccggtcgccaccaagagtgcaactaaggcgcggttgcgttccctagccacccccttgcccgggacgtgatcaggtagcaaatccgcctcttgcggcgttaacccgaccggggccaaccggggcgtttgcttagccttcagcaaggcgaccggatcgtggttgacctgccccgtcacctgtaagtacacataaaagcgacgtaggctgctaatccggcgctgaatcgtcgttgttcgccggcccttatcgtttaacgattgtaagtacgccgttaaagtagcccggtccacttgctgccaattagtgaccccccgactggttaaataggcggccgtatcccgcagatccgtcaagtaactggcgatggtcaacttggcgcccccctttttagtcaaccactcctggtagctgactagtgaagcttgcagggcgtctgaccccttattcatttactggcgcctctttgattaaaattagccggccgttgacctggctgaccaagcgggcctttaaaaggtggccaaccgcccgcttaaactgccccttggaaatccctaacagctccttgatttcttctggtgaactcttatcggtcagggggagctgcttttgcggtgcacgtttcaacagctccaggatctgcttggcgtcatcatcgattgcctggtaggcccggggctttaaggacaggttcaggctaccgtggccggacaaaccaatcacccgtgcgttaaccacttgacccaaacgcggttcctggtcccgctcgctggggtgaataaagcccaggcagtaattatcggtcaaaacgagggtaccggccatcttcaaccggtagacggtcgccttaacgttccaattgaccatcttcttttcggggcggttggcaatcgttgcaaaaatcgcttcgtccgcgagggtcccccacaggcggtcgtggtcatcgacgcgcaaggcgatcaagaggcggtcgcccggttggggccagaggtgctttaaagtcggcagttcgtccaaggaaaccaccacgtccttgttgggcaagccaatgtcaacaaagacccccaggtcgcggcgcaccgccaccaccgttccgaagtcatagtgatcgacggcaacggttgggatgtgttgacacgtcatctggagctggtgctggtcgttttcataaacgaagccggagaccgatccgccaatgtggaggacctggggggcttcatccttggggagacggtaggtctgcccgttgcgatccggttggacaaagtagtcctggtcgttttcatcaatcatgactgccgtcacgactttaccgagtgcttggttcatttcatttcctccgcttacctagtgcttaactaacaacctataatacaaaaatttacgccaaaagaaaaggagcgtggcgaagccggttgactccgcatcacgctccaagcacttaaccgggacccgtgctcgcttacgttccccagttgaattgcttacttaacttcttgtacccgcatcatgttggtcgtcccgtgttgaccgattggcaaaccggccacaacgatgatcttgtcaccaacgttggcaaagcctaagtccttggctttcttggatgctaattcaaacatttcatcggtgctggttggcttttcaaccacgtacggttgaaccccccagttgatcatcaggccgcgttccgtgcgttcatcaaaggtgagcgccaagatgtcagcggaaggacggtacttagagatcatccgggccgtgtaaccagaagcggtagcggcaacgattgcctttacccctaagtcacgggcagccgtggcaacggcggaaccgatcgtttcagttacgtcagacttgtcaaagtcaaagacttcccggccaaacttgtccaggttgttttcggccttgatgtcgatccggttcatagtggcaactgattcaactgggtagtccccgttagcggattcaccagacagcatcgttgcgtcggtgccgtcaaagaccgcgttggcaacgtcggaaacttccgcccgggttggccgtgggttttcttgcatcgagtctaacatttgggtggcggtgatgaccggcttgcccagttcgttacaacgacgaatcatgttcttttgaaccagcggaacgttttcggccggaatttcgacccccatgtccccacgcggaaccatcagaccatcagcgacttcgataatcgcttcgaagttgtcaatcccttcttgggattcgatcttcgggaagatttgaacgtcttccatgttcttttcgcgcagcaagacccgaatgtcttcgatgtcttgtggcttccgaacgaaggaagcggcgatgaagttgatcccgttgtccagaccaaagttgatgtcactagtatccttttcggtgatccctggcaagttgatggaaacgcccggtgcgttaacccccttgcgggaaccgaggattccgtggttcaagacgtggcagacaagttccttgtttgcttcatccttttcgtccaccaacatgtcgagcaggccatcatcaaagagaacgtggccgccttcgtgaacgtcgtcaaataaaccggcgtaggtaacggcgatcttttccttcgtcccttccaggctgtcgtccatggagatccgaaccttgtcgccgatgttgaattcgatcttcccttccttttgaacggtcgtccgaatttcagcccccttggtatcaagcatgattccaacgtgcttgccagtaatttcttcggccttgtggacgttttcaatccgcccgaggtgttctgggtgatcaccgtgggagaagttaaaccggaaaatgttcgccccggcgttaattaactttacaatcgtgtcaacatccgtacttgccggccccaaagtgctgacaatcttggtcttcttcataagtgacatctctccttttgcgttttccggactagttagtcccttttttcacattgcctatcatagcaccttttggggtgggtgtcttgtatatttccggcatttttcgctgtaaacggtttcttgatttggtttacctaacttaacgcttggaaggccaaattgctcctccccaccaggttaatcaaaccctcttggaccacccgttgcttagctaaccacagttgcccgggcagttgagtggctttttgagtgaccgggtcgtaaatcaccactgggacgttgccggcgtgttccttagccaaggccttgatcccgtcggtcaccgtggtctgcgcaaccccactaggtaagcggagtacccaacggtggtcggccgggtgtaattcccggttgaccacctgggcgtcggtcacttgatcggctaagagttggacctggccctctcgttgctcggtcttggccgtaatcaagtaaatcccgttgacccttaactcaccttcgagctgggtgaagaggcggttaaagatcgtcacttcaactgccccggtttcgtcactagcggttaaaaaggccattggtttgtgctcgcgcttggtcgttacctttcgcattcgggtcaccattaaaaccaaccgtacccgctggttaggccgtagctgggccacggttggtaactttaacttggttcggaggtcttggtactgactaaccgggtgccccgaaaggtaagttccgaggaccgcgtgttcgcgggccaggcgaacggcgagcgggtactcattgcgttgggcaaccacgggtgccatccccaagcccaaaccggcgtactcggcgccctccaaaatcgcctttaaaccctcggccatctcagctcggttgtaaccaaggtgatccaaggcccccgcgtcaatcaggggtacaaagagggcttccttgtgccacttggcgtcgaggcggttgaccaggtcgggcaagtcctggtaggggccgtgttggttgcgttcttcaatgattgcccgaataaagtcacggcgcaggcctttaatcatgtctaaccccagccacaactcctggtcgactaggctcacccgttcttggctctggttgatcgccggtccgtgggtggtaatccctagttgcttagcctcgctaaagtaggcccagaccttactggtatccgggtcggtttccatcagggccgctaggaattcggccgggaagtggacctttaagtaggccatttcaaaggccatcttcgaataggcaaccgcgtgggagcggttaaaaccgtagttggcaaactggtcgatgtaggcaaagacctgttcggcaacggcgttcgggtagccccgcttgttggccccggctaagaaggcctccttcatgctcgccatggtcgctagtttctttttgctcatcgcccggcgtaacaagtcggcctcgcccaggctaaagccccccatcaccgccgccacctgcatgacctgttcttggtaaaccaagattccgtaggtcggtgcaagaatcggggctagttccttagccggcaagttaaccgcctcttggcccttctttctggcgatgaagtggttgatgttgtccattgggcccggccggtaaagggcgttgacggcgacaatctcttcaaagttatccgggtgcaagttgaccaaggtttggcggatcccacttgattcaaactgaaagatcccactggtctggccgcggtcaaaaagggccagcgtcggtcggtcatttaaagcaatgtgggtgaggtcaaagtccggctggtgctggtggatcaagttaagtgccgtttccaccgtcgttaagttccgcaaacccagcaggtcaattttgagtagccccagtgattcgacggtgtctttttcaaactgggtcacgagcatcgcccccggctcgttaccggcctgcaggggcaccgtcttgatcaaaggttcggcggccaagacaactccggcggcgtgaatcgaatcgtggcggggtaagccctctagcttggccgccacttccagcaggcaggccacgagcttggaatcgcgggccaggttttggaccggctgggcgctttccaacaggtcggcgagggtctggtggggccccttaacccggtcgatcacctggctgagcgattcgacctgatacttgggtaagttaaagacccggctgacgtcgcgcaggacttgcttggtccccaagctgccgaaggtgatgatttgggcaactcgttcgtgaccgtagtggtggtggaggtagtttaagacctcctcgcgccggttatccggcaggtccaaatcgatatctggcatctgggcgcgctccgggttcaagaaccgttcaaacaacagcccgtattggagtgggtcgacgtcggtaattgccagggcgtaagccaccaaggacccggccgccgacccccggccgggtccggtcaggatctggtgttggtgcgcaaagttcatcaagtcccagacaatcaaaaagtagttgtcaaagcccatctggtgaatgacggttaattcatgctccaagcgggcctggtactcggcgggatcaccggccaactttcgcttagccaacccccgttgacacagttcgcgtaggtagtcagccacgccctggccggccggagtcggaaaagcgggtaggaccggcgtttgatcggcaaagtggacctggcaccgttcggccaccgccaccgtttgggccgccgcttccgcaagccccgccgcccggtaggccgccgccacctcttcagccggccgcaaccagtgccgacccgttcgctgactggccttgagggggtcttcaatcgtgtggccggccttgattgcccgtaagacctgggtggcaaagtaatcatcctcgttgaggtactcgaccggctcgaaggcaattaggggcagcccacagcgctcggcgacggcttgtaagtcctggcgctcggccgccgtgaaatcgaggttaatccccaggtagtcggccacttctccgagctgggcgtacgtttgctcactaacgcccaataacatcaactgcggggccacgatcacgaccaggtcgtctgaaacctcccgtaaatcttcgatggttagtggttggttggcccggtcggtcatcgccctggtcgagaggcgggttaggttttggtagcccaccgcccccttggccagcagggtgacgtctaaggttccctccgcaaaggtgagcggtaggctgacgccgatcaccgggtgtagcccggcttggttggcccggcgaacgaagttgaccgccccgtacaagacccgcgcatcaacaaggccgaccgcctggtagccccgctctttagctaccgccaccagctccgcggggcgaaccggcgcctctagtagggagtacatactcttaacggctaagggtacaaagcccatttcaacccctccttttcttcttacttatcttaccacagggcaagttaataacttcactgttctcccccttcattttgtgctaaaataccagtgtactttaaaggggtgaacttcatgaaattagtaatgcaaaatgtaatggccgtcttttggggcgtcatctttgggctggtgattggttacatcgctggtcaacttgaatcggcgaccactaacttcaccaccgcagcgatccttggtggggtggtagccttgatcttcgttaacgtgatgtcttggatgactagtcacgctgacccgtcacgccacactaactagccggtcaacaatcaactcaaaaagggaacgaacttgggtgctgcacagttcgttccctttttttgttggccttattcttcggcgtttaaggcgatcatttttaacaagacgtccaccgctttttccatcgtttggacggaaacgtattcgaagcggctgtgcatgttttcacccccggcaaagaggtttggcgttggtaggcccaggtaagaaatcgtggagccgtccgtcccgccccgcaccgggtaaatgtcgggcttgatgcccaggtcttccatcgcctttttggccagttcaaccacgtcttcgtgacccttcaaggcgtcctttaagttatagtactgatcgtacaagttaaggctgatccggtcctcacccaggttagcgtttaggtcgcgcacgatcgcccgtaaggcctccttgcgcgcctcaaagagcttcttgtcgtggtcacgaatcagatagactaagcgggcgtggtcaaccgtgccatcgaacttgtaaaggtggtaaaagccctcccggtcggccgtcttttccggccggtcgtgcaccggcagttggttttgtaagtcgatccccacctgaatggcgttgaccatcgtgtccttggccgtgccggtgtgaacgtccttaccctggatgtcgatctcggcttgagcggcgttgaaggtttcgtcctctagttcccccagcgggccgccgtcaatcgtgtaggcaaagtcggcaccaaagtctttaacgtcgaagtgatcggccccggtcccgatttcttcgtccgggcccaagccgatttggatctgaccgtgcttaatttccgggtgttcctttaggtaggctgccagggtaatgatttcggccaccccggccttgtcgtcggccccgagcagggtcgtcccgtcggtggtcaccagggtttgaccggcgtacttcttgagggagggaaattcgtcaatcgtcaacttgtaacccgaatcacccagggcaatgtcactctggccgtcgtagtcttccaccacctgggggttaacgttttcggcgttaaagtccgccgtatcaacgtgggcgagaagccccatcaccggcaccggtcggtcgatgttggcggggatggtggctaacaggtaggagttttgggggtgaatccgcacgttttcaagccccaattccgtcagctcggctgctagctgctttaaaaaggccgtttccttagggctagacggtaccgttttcgattggtcgtctgagcgggtttccaccttggcgtacttaatgaaacgttccaataatcctgggtactttgaatctgtcatcttgatgcttcccttctaactactttgtgacaaactgaaacggctcggtgttgactcgggagcggtaaagcgtgattgaccactggtgctcttgttgccaattttgcaacaagttagccaattggtcaatggcgaccgcttcaatgtggtggccggggtcaactaacaccaccccgcttgcctgggcgtcgtgggcggtgtggtaggaaacgtccccggtcacgtaagcttgggcgcccttttgctgggcgtttaagtaaaactcactccccgagccccccaaaattgccacccgtttgatcgacgcgggggccggtgtcggcgtaaccacccgtaagccggtcaccccaaaactggttaggcagtgcttagcaaagtcactgacgctaagcgactccttaaggtcaccgatccggcccatcccaactggttgaccggtaatggggtcgtagccggcctccaccaggggggtcgtgttatttaaccccaactgatcggcgagccagtcattcatgcccccgttggcggtatcgaggttggtgtgggcggcgtaaaccgtaatttgatgggctaagagcttagcgtacatggcgttttgtgggttccgggtatctaagtccttggccggcttaaacatgaccgggtggtgggcaaagatgaagtccaccccctggtcaattgcttcgtcgacgactgccggccgaacgtcgagggtggtcatcactttgtgcaccggttgatcagggttaccaatttgcaggccactgtgatcccaactttcggccagttgtgggctggcaaagcgctcaaagtgggcaatgatttcggttcccttagtcatcttctaaaaccccctttattagcgccacccgggcttcgtaagcggccaaacggtcggccggaacctccttggccccgctcatttgctcgatggcgtactgatcccgggctagttccttttgccactttttaacgaagaccggcccccccgcttgaattaacaggggaccaaacagggcctcgcgttggttgtaggccaccgggttaggcgtcggggtggccacgataatttcgtaaacgtggtcatcttcttctaggatctcttcgtggataatttcaaagtggtgcttagccaaccaaaggcgcaacccctcttcgccaacgtttggctggaggatcaagcgcttgaccccttccaacttctcctggccggcgtccaagatcttggtgatcaaagccccccccatcccggcaatcgcaatcgtgtcaatccggtcttcttttcgaattgcgtccaggccgttggcgaggcggggaagcaagtggtcagctaggccgcggtgctccacttcttttagcatgttttcaaagggtccttcgactacttccccggcgacggcaaaatcgatttgctgagccatcaataaatgggctggcaagtacgcgtgatcggacccaatgtcggccaggcggctccccttgggaacttgtgctgccacggcggctaagcgctttgataagttctgtgcatccattaaatttcctacccttcaccaataatttcgtttaaatgttgtatgttttccgttttacccaggacggtaatccggttgcccttttcaacccggtcttcaccagccggcagtgtgttggcctggtcgtctttagtgacgatggcgatcacgttgacttggtaacgattccgaaagtccagctcgctgagtgtcttgttaaagaagcgggggttgacaacggttacctcggcaatcgtcgtgtcgtcgctgatgtgaacgtaatcgatcagggacgggttgagcttagcaaagatcaagcgcttggccaaatcgtgctcgggacgaacgaccaggtcggcgccgacccgctgtaaaacccgggcgtggttacggttctccgcccggcagataacgtcttttgcccccaggtccttagcgattagggtcgccatgatcgaggcttcaatgtccttgccaatcgaaacgtacacgtggtcaaaggtgccgattgaaaggtcctttaaggcctcttcgtcttgggcgtcggcaatcaccgcccgcattaccgagccggctaagtcattgattacttcttcgttagaatcaatggctaggacttcttgccccgcttcgaccagggcctcgcacagcgccgagccaaactggccaatgccgatcacggcaaagctttctgttttatccaattagaacacgctcctctgggtaccgatacgtttgacggtggggctgggcgttaaagatcgagaacatcaccgtgtaaatccccacccgcccgatgaacatcagggcgatcaaaatcattttgcctaaaaagttaaactggctcgccattcccaccgagatcccggtcgtcccaaaggccgacaccgcctcaaaggtgactaaagacagagcatcgtggctcggcaagggctgggtttcggccagcaggaaaattgccccggataggatcactaaggagataaagaccagggtcagggcccggaagacgttttcctgagcaaaacggcggtgggctaaggtggtgtcgcggcgcccacgcagggtcgcgagtgtctggagggccaagagccccaccgtggtggtcttgatcccgccggccgtcgaacccggcgtccccccgataaacatcagcaaaacggtgaaggccaagccggctgccgacagttgggtgtacgaaaaggtcgttaacccggccgtccgcggggtgatcgccatgaacaccgtgttgacaaagcggttaaagccatccatttggccggcgaactggtggaggttgcgttccgtaattaagtagacgatcacggaccccaccatgatgaccgccccggtgcgcagggccaactgggtgtgcaaagacatttggcggtggcgccggaaggtcaacaggtcatcccagaccaagaagccaaacgagccggcgataattaacagggcgaccaccgttagcaagtagggatcctggcggaagttggctagcgagttaccaaagaggtcgaacccggcgttacaaaaggcggcgatggcgtgaaaaacgctgtaccaaagccccttcaataatccgtagcggggccctaagtcacaccacaagagcagggcgccgaccacttgaatcaataccgacaagcggatgatcaaccctaccaccttcaattgcgaaaggtggtctaagttgagggcttcttgggccaacaggcgcgttgacatcttcatccggcgccgaatcagcatcgacgccatgacggcaaaggtcataaagcccagccccccgacttccattaggacggcaatcaccgcttgaccaaagggcgaccaaaagctagcggtgtcaaccaaggagaggccggtaacgcaagtggcgctcgtcgacgtgaacagggccgtaataaatggagcccgcgctccccgggtggccaagggcaacatcaacaaccccgtccccaccaagattacaattaaaaagcccagcgttaatagcttggggaaggataactgatgattcttgatttcaaccacgaccggaccgcccttcttttagcccctattattactcatttacccggccaacgtcaattgaccgccgcgatctaagaccataaaaaggggcgggaaaattgctttcaagtttcagcttttaatcctaaaaagaggctaagggaaagcaccactttcccttagcctcttttttatttagatgaatccgtagtatggccgctggcacagcgactggtgcaaccagttgattaaggtgatgaagtcaaagaccggcaagccgacccccgcttgaatggcggccgcgtacgggggtaaatcgctacattccaagaggagggcgccgacgctcgggtcctgtttgacggccgctaccgccttttggaccagggcccgttttaaggcgccgttatcgagggttgtttccccgtaacggatggcgtgaaattccggcaggctgccgatgtcaacgaaggtcaccttgtcaggcgtggcgttaacgttggccagcaattcaggggtcgccccctgaatatcggccaccaatacggcaatccgttggtcggcccgtaagctcgtcttaatcaggggtagttgggccaggctcgacaaaaggaccggcacccgcacggctgcttggacctgggtttgaaagttagcaaagtagccacaggccccaacgatcgcccgcaccccgcgggcctccagccacttcgccgcttgaacaatttggtcgaccgcccccggatcggcttcaaagagctgctcgatcgccaggtcaattacctcgtagtcgaccggaaaggcaaaggtgctagcgttggccacgttccccggtagcttggggtagaccaggttcacggcgatgattccgatcgccgctccggccactggttggggcgtgactgacaccactccgtccaggtccgctgggctccccaagtagtcgcccgtcttcttcattaagcttcctccttatagttgccgttttccaggtagtccaacagttcggcccggtctaagtggccgatcccgagttctttaagggtgaccccggtttgatcaaaatcaatcccggccatcgctgaccctaaggtaatgatgctgtcgatcaccggggtcttgacgccgaacttttgccccaactcgtggtagatgtggcaaccaaccgggatgtcttcggtcacgtaacggtcctggatgctaaacggcccggtcccaaaggccatcgggaactgctcgtcaaacggagcgctggccccgtcgcccatgtactcgggccctaagatgttagagcgtgaatagaaggtttccttggggtacctagcgatgtcgacaccgatcttttcggccagctcgatttcttcttggtaaaaggagtactggaccgccgaaaccgactcggtgtaaacgtgggaataaattgaaaagtcgctcttgtcgttgccaccaaagacgcggccgtagttttccatcactgcggcccccagaatcgttcccgggcagtggagggttgggttgacgttgctaaagccaacgtctaagaccgttttgccgccgaccgggccgtcgccaaaggtcaccgagtcaaagcagccaatgtgttcggtactctttaaaaaggcctcctgatcggtggacggcaaagacgccccccgcagggaaaccgcccggtaacgcaagaagacccgcttggtgtcaattcccgcttccttaacaatccgggtaccgtacggggcactcgaccagcccccgacaatcacgtcgacgtccggcctggtttcgcgcaggaccttgcgtaagcgcaggctaccgaagttatcggggataatgtggatgatctggccgtcttctaagagcggcaccagccgttcaaagaaggtttggtgaccaaccgacggcaccgcgactaaaatgatttgggcgccggcaaccactttggccaggtcgtcagacaccaggtcgaacttggcgatcccattgcgcttaaagttgtacttgcccaactcaaagccttgaatttcgatcccggtcttgtcgaggtccttaagtgattcaccggcaaactccggtaggtcaaacaaacggacctggttgccggccaacttacaatcggcggccaccgaccggcccacggccccggcccctaaaacagcaatcgtataatctgctaagtgttgtttggtcatggttcttcctcctttaattaaaaaacgccccgaacagagtttcctctcttcgggacgtcaaacgtgataccaccctcatttaagcaggggtcaccccccactcctcaataagtacccccagcggggagactcaagcggggtaacgaccgctaaccgggcggggctcaccagcgttcaccccaccaactgctccggaaccatcttcgtctaccgccgcccccgtggtttccaccagtcccacttctctagttggggtttggttagcttactcattccattaacgcattattatttatttttaatcattttataagggcggtttaactttgtcaaccaaaatttggtagcgttttactcgcaccacttggcgagttagcatgcagatttcattccaccaacccccgcgccccttcaatagcgtataatgaaggcgaaaggaactccaggctaaagacgttttacaccgaccgctctcgtcgaattttttaaccgacgtctgtaagggaatttcaatcgggttagcgaccggcttggtggttgcactctttcgctggctgattgaccaggcgatgctctttgcccgcttcgtttaccccctcttacgcagccaaccactttggttaatcccctatctgatcgccaccgtgatcatctggggactcttaagcttggtaattggcaaggaccagactgacctgctcggttccggggtcccgcaaatcgaagcgatcttaaaggactagcaccggatgaagtggtggccggtcctgtggaaaaagttcgtcggtggcctcctggcaatctgcccgggcctgttcttaggtcgcgaaggtccctgaatccagatggggccgcgatcggccagggaatgggtgaacgcctttttcacgccgaccggaagaaaacaagctcctcttatcgtgcggggtcgccgccaagttggcagccgccttttccgcccccttagccgggacgatgtttttactgtaagagatcaccttccgcttccagattcgcgagtggttgaccgccctagctgccgccatcagtgccgacttgatgaccgtgctcgtttacggcacccgcccctgcttatggctaccagttaatttcaacctcccccccgtcgcctacccctggctgatcctctttggcctggtcctcggggtgttggcctggtgctaccagtactgcctgttgaacagccgggtctggtaccgccactgcactcacctacccagcaaggtccaaccacttgctggccgccggcaactacatcaacctggtcgtgatcgggatggccgcctactttggggcgattgaaaaggcccccttcaccgccatctgtttattaaccgaaatggttggtaccatggagcaaatcttaccgatgctgatcgtgaccttcatttcctataccgtcaacgacttactcggtgggcggccaatttacgccgcccttcgagaagaaatgtttggcttggaccaaacaagttagtaatttctcctacaaagcaacagtccccaccagagctagcaacttgctggctctggtggggattgtttggttagctaaattttttcaacccggttttagacactgcacaaatgtttagatttgtcgggtgtgattttcttaaataagcgctgaccgggatcatcaccccgttaaccatcaaaaagccggtcgtcagccattgaaccgtcgaggtgttgacggcgaagtagcgcatcaaggttgggtaggcggtcgccagcaagttctgattcaaaacggtgcaaaaggacccggtcattaacactacaaccatgatggtccgttggggctgggtaaggtcactccgcttagccgtgttcatcgtcttcgcccctcccttggcggtcgatcaatgctcgtttcacgtttcgccaacgtaagcggaccgcctgacggtcggcaaacccggctaggagctctttctctagcggtgtggtccccttgaggaccggttcctcttgcaacgattcagcaattcgtgagcgccctggcccacacgattgccggcgtcgatcaactggagcgaattgaccaaaccctcgagtcactccggttaaccgggtcgatccggctggctgcccaactactcgaccacttagaagagattaccggcgccaatcagatcaccagcccccacttaaccgccctgcttgaccattggcgccaagccctaacggaataaagggatcaaaaaagcccgcccggaattcccggacgggcttttttatggcgcgcaccacatttatatgaggggtaaccccctcttcgcttcagaaaggcgcttttctaagcgattaatttggttaggctaggccttcttaactggcttcttgattaccgcaaagataaccaaggagatgataaccattaccaacagaaccttgtacagtaatgggaagttttgcgttaagaccgccccgttagcaagggtgaccttacctgggttcagtgggttacctgatgccatcaggaaaccaaccaggatggccccaatcccgaacccttggtagattaccgagtagttacgggaagtatcgcgaagaccgaagtagtcagaaacgaaggttgggaagacggtgatgttcccaccgaagcagaaggccatcgccataacaaccgtgtaaatcatccccatgctcatgtcccccggcttggtcattaagagggccaagagcgtcaggagttgaatgatgaaggtgataaagaagactggcttccgaccagtaatgtcagacagccaccccattacgaaccgaccaatcgtgttggcaattgccaccacggccacgaagaaggcggcggcgctagaaccggcccagatcgaaacgtcctttggtgattgggtccaagcagcggccatgttcgtaacggccgcccccaagagtcccatgaacatacatgccgtcatcaagcagaagaagatcatgtaagcttgtggcgtgtgtagcatttcggaagttgagaagttaacgttttcggatttagcttccgcagcgcttggtgcagtaacgacttctggggcgtcctttaacagtaaggaaccaaccacggccagaactaaggccaaaatcccccaccagaggagaacgcgaccgatgttggaggcgttgatcacaccgttaccaccggcaacccacatggcaatgtacttgaagacaaaggaaccaaggccgtaacatgcgacacagatcccggagattaaccccttcttttctgggaaccacttaatggcgttggtcaaagaggttaagtaaagcaccccgttcatcgccccgaggagaacccccccgaagagccacagggtccagattgatgatcccttaccgatcatcgtcaaaccaagaatggaaagaccataaataattgctgcaatcgtgttgacaatcttaatcccgtattttttagcaagcgggatccctgctaacgttgctagggacaagcaaagcatccctaaagtaaacgtgaaactaacggacgctgccggaagaccaccaacgatcttctttgcgccgttgaccattttaacaaccccaccggttttgagcataaacccgttgttaaaaatggcccatgcgtaaaaggaaccggcagaaagctgaataaacacagttccgaggacaaccatccaccggtttgtgttttgcttagtcgtatccataaggtacacccttctttcataatgactaataacaaagcgccttcatagatagtttaacatatttttaacaaagtaacccaagaatttcgtaacaatcttaattttattgtaaataatttattgcactttttatcattaagaggcaattattttatattaaatagatgaaaataactcatttgtcaccaaacttgttcattttagtaaaagttagctttgcgaaagggctttctcttgctctgaatttcacgatcactcaaacccttgccgctacttgtctagtgatagttataatccccgaaaacactaacctttaaacttcccctcagccaacaaatcatagtaaatagttgctaggtattagacattcttcacccttttgatcgtaatcacccgttaccaaaagaggtagggcgaaaacacggttttctccctacctctttactgtattcacggatgttagacgggaaagatggccaataaccgcaggtctagtgtctttacaggccgaagtacggtgcgtcctaacttagtcgtccgatctgccgcggaggttatttcacaccgacctcatttctgttaaatctcaaacccaactcttgagcaagaagaagaggacgggtatcaggagcgccggtaagagattaaccgttttgatctcccgcagcttaagcagagaaatccccgaagcggcaatcaaaaggccaccgacgattgaaatctcggtaatgaagctagcactaaaaaagctcgtcgacaggtacttggccaccaggtagatccccccttgccaacaaaaaaggaccggcgccgctagcatcatcccgaccccaaagctggcccccaagatcaccgaactgatcaagtcaagggtggcgttggtaaagagcatcgtggggtcgtgcttgacggcggccattaccgggccgacgatcgacagggcgccgatgcaataaagcaagatcccggtggacagcccgcgccccagctggctttggctgtggcggttgacgaggcgattaaagcgctcatcaaggttcccccaagtacccaggaccgccccgcaggcaatgctgacgataaaaaggaccgggtagtggctcttttgcatattattgaccacgttttctaaaccgatccccagcgccgctaaaccaatggcgaggtaaagggcctcttggtagcgtggcttgataccaccgtgtaagaggcaaccgatccctgtccctaccaggatcgctaaggtatttaagtaggttccaatcatttgctcccctccctggggttgtcgtgttggcggtgccaggctgcgatggcggctagacgttgtttgacccaagcctcgttaccctgatcggttgggcgatagagcttcgccccgcttatttcgtctggcatcgtctgcatcgtcgtcaggcggtcgctactgtcgtgggcgtactggtagcccttgccgtaatcaagctccttcatcagcttggttggggcgtttctgatttgaagcggtaccggcaaattcccggtctgcttgataatctttttcgcccggttgcgggccgcgtacacggcgttggacttaggtgcggcagccaggtagatcacgcactcggtcaggtggacgtcacactccggcatccccaagaactggcaggcctgaaaggtgttggtggccacttggagggcgttggtgtcggcgaggccaacgtcttcggcggcaaagcgaaccaagcggcgggcaatgtaaagcggctcctcgcccccggccagcatccgtgagcaccagtaaacggcggcgtcaacgtcgctgttgcgtattgacttatgcaacgccgagatcaagtcgtagtgctcgtcaccggcccggtcgtagcgtaacgaacgggtgctggttaattgggtcaggtcggcgttagttaatttaacctggtgaccgttgcgttgaccatttagcaccgccatttccaaggtgttaagggccatccgggcgtcaccgttggcaaagttggcaatcgcttctaacaccccgtcttcaaccgtaatctccaagtcggcaaagccattcgggtggtgtaaggcccggtgcaaaattttaaccagggcccctttatcgagcgcccttaatacaaagaccttgcaccgcgataaaagggcggcgtttagttcaaaggacgggttttccgtggtcgccccgattaagatgatctccccccgctccacgtagggtaaaaaggcgtcttgttgggccttgttaaaacggtgaatttcgtcaataaagaccaccgtccgctccccaaactggtggttagcggtcgccgcttccatcacctgcttgatgtctttgatcgacgaattaaccgccgaaaaggtaatgaacttggccttggtcttttgggcaatgatttcggccagggtggttttccccacccccggtggcccccacaagatcagggacggcaaccggtcttgttcaatcagctcgcttaagacctttcccgtgccgaccagctggtcttggccaaagaactccgccaactccctgggccgtacccggttagctaagggcgtcgcaccaccctgactactagcggaaaagagtgattcctgttccatcgtgcgtgcgccccctaattcagcaccgcccggtcaaccgtggcggttggaaagtgttgtttgacggccctgatgtcgtcctcagtcatccggtggttgtaataaattggtagcgggtggtctttgatcagggttgccacctggtctaaaaagtcgtcccagtccatctcccgttggttaacgacccaaagctccgtttgcgacaggccggggtagttaccattcgaccaggtcatcaggccccaaaagtactgcctagttagttccggtgttgccagccaataagcccgggcccggttttgattttggttaactaagcgaactaggcgctcctcaaccgtttcttctggttcttgtttttccaatttgctgcccccttttaacatttcccctattgtaacaaatcaggcgctccaaaaacaaaaagggccgggagaactgtgagttgctcccggtccctgatattggatacgttaaacaattaagagttcattaactggtctagcagttcctgggccgattcgtgcagggcgtctttagacttgtcggtccctaggtgggtgtaaacctcgcccacgtaaacgccgtccttaaagaggcgcttgaagacttcgtcgatgatcggcttggtccgttccggttcttgaaccgggccgaacgggttcgcgaagaaggtggaagacatcccgacttcatcggtcgtcccaagggccttgcgcttaccggcgataaagacttccttggcttcctcttcgttttcaaattggtggaccccaatcccgtcggagtagttattggcgtacacccacatgtcgatttcgtggtgggccaccacgttttcgtacgcgtcggccgggatgatcacccgggcgtttttccgttctgggttcaagaagaccccacggtccatgttgctaaaggccacggaagaagacaaatcgtcgaggcggacaaaggctccggtttcggtcccctgggcgtagatcccgcccttggcctggtcatccaggataaaggagcccatgtcgtcgaagatggtttccatttccacgatttgttcatcggcgatttcctgcagggcttctagcgattcggacttcccggcgccggaatccccgaagaagaccaccgtcttgtccttgccgttggtgaacttaatccgcaccatcgacccgtggattggcagcttgccgctgtagatttggtgtaagttgtgcagggttaggcacatcttcttcatgtaaccaaagtaggtcgttttgtcgttgtacgggacttcgccgacccaaaggttgttgtcgctgtcgtagtggtagtgcgatacatcgcccgccgtcttttcttggccaaaaatcaagatggcatcgggcttttgcccctcaacttcttctgccgttgccaattcaaacaagttagaaagggcgagcccgttaaccatataatcgacgtggaagtaaataaagatcaggctttcaccgaccttagccgggtagcacagccattcttgacgctggccggcaaagtggtcaaccggattgtaatctacggcggaaaagaccccttcccgcttgttggacttggtgtgcatcagcattggcggctgcaacatgaccttgtcaatgaaggttacgtcggtcaaggattcgtaaccctttggtgccggccattggtggtcgcgaaccagcagggtagcgttagtcccggcgttaacctgacggtaaacgttgttaacaaagccctggagcttttcttcgatgatccggtagttgcggatcactaaatcgttgaaccgggcgtcggcttccttaaaggagtgggtaatcaccgagttgtcgttgaagttagtgattgaaacccgcaggaaactccggtaaaaggagtacagtgattcaaaggaggccaggatttcttgaggcgtaaagtcatcgtaggtgtggtcgtcgttgatgaagaccttctttaggatcgccacgtactcttcggcggagacgttttcgatcccatttgcgtccttagtgtggtgcgatgaggtcaggtaaagacggatgatctcaactaatcccttcgaattgatgagattatagaagttgttaacatagtatttactgaagtcgagggtggcaatcccccggtcaggattcatatatagggcgtcagtacgaacggattggtgagtttctgtcataaacattcgtcttcctttcatcttagctatggaaacattataacattctcatttaggcttggcgttgctaaaatgcaactttttgcaattttattacaatccgtctaatcaaagaaaccgcttaccattagatcattcaacggatcggcggcgtcatttccgaacgccctaatttaagtggatcgtcgtctcggccggcttagtttgggccagaacacgtccgtggcggatgttgtacaggacttcggcgtgttggtttagggcctggtagaagttctgaccgtttaataagatgcagtcgccgggcttaccgacctcaatcccgtactggtcctcgatgtgcagggtcctggccgcgttggtcgtcacaaacttaaacgagtcttgcaactgggaataacccatcaggtgggcaatgtagacccccatcgtcacggcgtcgagcatgttaccatcacccagcgggttccacgggtcctggacgtcatcttcaccaaaggaaacgttgatcccggcggcgtcgagctccttgacccgggtgacgccacgccgcttcgggtaggtatcaaagcgcccgcccaggtgaacgttcaccagcgggttagccacgaagttaaccccgctcatcttcaagagtcggaacaacttgtaggtgtacgcgtcgttatacgaacccatcgccgtggtgtggctcgccgtcacgcggtcgcccatttgccgttcgtacgcttcggtcgccagcacttctaggtggcgcgacattgggtcgtcaatttcgtcgcagtgcacgtcaactagcttaccatacttgtcggctagggccattaagaagtggaccgattgccaaccgtactcggtcgaaaactcaaagtgcgggatccccccgaccacatcgagcccctctttgaccgcttgttccattaattccttgccgtgcgggaagcttaagatcccctcctgggggaaggccaccaactgcaggtcaacctggtcttttaagtcgtgtttgagttccaagagggcctgggcggcgatcaggtgcgggtcggtcacgtcaacgtgggagcggacgtgttggattccgtggccaaccatcttcatgatcgtctgcttagcccgcttcttaacgtcttctttggttagcgactttttacgctcgctccagattcggatcccgtcaaagagggtcccggattcgttaaactcgggctgccccgccgtcaaagtcgcatccaagtggacgtgggaatcaatgaagggtggcaacaaaagtttcccgttcccctcgattacctgctcgccgggcttgggagttagcccggcttcaatagcggtaaacttgccatcggtaatcgcgacgtcaacgagttcgggttggttgttaacgtggacgtttttaattagcatgattaactcctttgtaattttgacaggaccatgtacaagaggctggagactaccatgtcgataaaggtgatccccaccgtgttaacgaagaacgtttgtttttggcaggccaagaagatgaccacccccaccacgaaggtgatgatcgccgccgggttaaccccgcccttgtaccaataacgccccttaacccggccaaattcttcgacctggtagtggcgctttgccttccagtaaaagtcggtacaaatgatggcaatcgtgggtccgaggaccatcgccacgtaatccagaaagctttcgaaggtgtctaaaaaagaaccgacaaacatcgggattaaggtcaccaccgttgccaaaatcaccactatccagagggcgagcttcaggtttagcttggggaagatgttggacagggccgaccccgcccccaagaggttaacggcgttggcggtcatggaggtcaagacgattaccaacagggcgatcaccccgaggccgagcttggccgcgatcgtgctggggtcggagttattagcgttgtaggccccggaagtgatggcaatcgaaatcgttgaaatcaggccgatgaaggcaaaccagagcacccccaccatggcgccgacgaagggagagaccaccgaattagcccggctcggcgtaaagcgggtgaagtcggctcccgccgttacccaggccaagttgaaggcggccacgtagtcaattgctgccccggtcgtcattctcgccttggccggtacttgccagtgagcgatttcggtcagggagaccgtcttgaagacggccaccgattcccaaatcacaaagaccagcaccaaaataatgcccagccgttcaatcatctgaatcgaacgggacccggccgacaccgacaggatgtgcaagatgctcatcacgatgatccccaccacaaggcccttggcacccccgggttgaccgaaacttggccaccccagcagctgggttaagattaacccgaccgactgggcggcgatgaaggtgttgacggccgtccagccgatgaattgggtaatgttcaccagggatggtaagtagctcccccgctcgccaaaggaggcccgtgacaggctcatcgtcgacagaccagttttgtagcccatataaccaaccaggctcaaaaagacgtaggataaggccgatgaaatcaccagcacgttcatggcgacggcaaaaccgcaggcggcgagcaccccaccgacaaaccaagtcccgttgttggcgttggcccccacccaggtggcaaacatgtcccaccagttagtgtggcgcgcttccattgggatccgctcgatcatgacctctttttgctttgtttccattttgttctccttcaaaaaaatccccgcccgggtggcgaggattctaaatgacgggactacacccatcttttgtcgtcttcgccgcctctctggacgtcgttaaagactttcgtattttcgtttgttcaattataacagtcccccgccggttgtcaatcaggcgccgggcaaaaagaggggtgctaacctttccagaccggcttggtcctcctgatcaaaccgggcgagcttagggctgtcaatgtctaagaccccccagagtttgtcgccctgataaattggcaccacaatttccgagtttgaggcggcgtcacaggcaatgtggccggcaaactggtggacatctttcaccaattgggttttccccatttgggcggcagtcccgcaaaccccgctaccaaaggcgatgtgcacgcaagccacctgtccttggaagggacccaagatcaattcaccgtcctgaacgcggtaaaagccggcgaagttaacgtcagctaagccgttatagaggagggccgccaggttactggcgttggcgatccaatcggtttccccttcaaagagggctaaggcttgctggtaaagtaattggtaatctgcttgtttactcatcatttttttcctcatcgtaacgcttgccaaagaaaaccaggtcctgagttttgtccgggaagctagccacccccggaaaggccccccacttttggtagccgaacttcttgaagagggcctggctagcctgattggtgccaaagatgtaagcgaccaccgccgtgatctcgcaggcggctagttggctttccataaaggccagcgccttagtgcctaacccctggtggcgaacggcctggtcaaagtaaattgccacctcggcggtgtggcggtaggcggcccgtccataaaagggctccagacccacccacccaatcacttggccaccatcttcaacgacccagagcgggtgatcgtcgctaaaggagttaaaccacccccgccgctgttcgaccgtcacgggctccatgtcagccgtcaccgcgtggggggcaatggtttggttgtagattgcgacaatggttggtaagtcggctagcgttgcttgacgaaaattaatcatcaacggtccccctttattcattatttcttgttaattatacgctgaccgggtcaaaaggaaagggctagttaatttaggcctacagttttccagtggctgaaatttaaaaagggccctgggccaaacgaacccagttccctttcactcctgtactattcaaacaatgatcggtactgaccgtaaccggcttcttctaactcagcaaccgggatgaagcgcagggccgccgaattgatgcagtagcggaggccgcctcggtcgaccggaccatcggtaaagacgtgacccaggtgggaatcggcctccttagagcgcacctcagtccgttccatgccaaacgactggtcgcggttcatggtgagcttcgtgaccggtttagtaaaggacggccaaccgcagccggcgtcatacttatccttagacgagaagagcggttcccccgacacaacgtcgacatacaatccctcttcataaaaatcatcgtacttaccggtgaaggggcgttcggtggccgcctcttgggtaaccgcaaactgggtcggcgtcagcttctttagcgctgcttgcttgtcttccattgcgtcctcctagcaatcgtgggtcgtgccctgggtggcgttggcgttgactggttcggtaacgtcgaggatctccacgctatcagttaaaaccccgtgtggcgaggtcaaggacatcacgaagtaagtcgggttaaaacgtagttccatcccgtcggtgtattgtggggcgtcaaagcccttgtagtacacgtcaccgaggttggacgggaagtgggcgtcaaagtccggtaaatcagcatccttatccacaaagatcagcttgtagttggccgcaagcgaacaatcgcccagcttggaaaacggacctacaccgtcatcgtaatctaagataatcttcttgtcgggggaaaggtaacgggccacccgttcctttgccgcctcagtaaaagtcagatccacgctaatcactcctttattcgttcaggcatccatgcaattgtctttagtttaccattattttaagtaagcacaactttaatgctcaccaaccaccgaggtccttcccggctcgcgcaccgaaaaagcggtaaacgaataaggggcttggagaatgcctcgttctccaagcccctaggttcattttaatgtactactagccttcgaaggccttagtcaacggtggaacaacttgcttcttacgggaaactacgcccggcaggttcatccgcttttggtcgtttaacttcttgtcaaaggcggcttccaccttgtcaaggttggcaccgagggccaagaggtcggagtcgctgttcaagatgttggtcacgatcagaacaaaggtgtcgtaaccgttttcgtccatcagggcttgcatagcggcttcgattccctcttggcgggagaagacatcgtctaagtcaaccgtgttaacttgcccaatccgcaccttgctgtccgccagttcaaaggtcttggcgtcgccgtcaacgattgcttcgtcactcttggcagccaagttggtgccggcctttaacatttgcaggccgtattcttcgtaatcaacccccgcaaccttagctaagtgcttaacggcttccccatcgtggtcggtcgtggttggtgacttgagcaagagcgtgtcggaaatgatggccgaaagcatcatcccggccaggttttgcggaatgtcaatgtgggcgtcttggaacagttccgtgatgatcgtggaaacacacccgtacggccgtagggttgcccacagcggttgggcggtgttaaagccgttcaaacggtggtggtcaatcaggtgggtaaccgttacttgatccaagtcggcaacgctttgggctggttcgttgtggtcaaccaacattacggcgtcaacttcattagccaccgtttcaaccacccgtggtgcttgcatcccgaacttattcagggcgaacttggtttcgtcattgacttcgccgagggcaacggcttccgtttcgtaccccaattggttttggtagtaagaaaaggccattgcagcggcgatcgtgtccgtatccggcttttggtgtccaaaaactaactctttactcatgtctaggattcctcctcaaatttaacgaatttcacttcgctgatattacatattttagcatgcagccccggggcgtgcatggctttttcaaaaaagctaccgctacacccctaggccttttgttcttgcttggcttcggttaggcgccggtaaagttcgcggccgacaatgtcattagtccacatccaagcgatgtgacccaaggcttccgacaggtgctcttctttaggctgttccttcgccgacgggacggtccccattgctggcataatcccgaggtggaaggccacccagaccgccaagccaaagatggtcccgtagcccttctttaggtactgagagttttcgaccaacacctcgtaaatgatcccaaaggagaccgaaaagccgaagtggacgataaacgatacccacggcatttcctggtcagaataagtgtaggtcgagtgggtgaggttcggtgacatccccagttgctctaacaagcgttggggtgggttggtggcgttgcgttccggcgtccgtggtggtaagacgtcttcccagcctaatttaaccagcccggaaatcagccccgctgccgtccccgccttgatggcggcctttaagttaaagttctttttcatgtttaacacctctcgtctaaattgagcgattacacaccattattataggcgtttttaggggtggtttacagtaattcgatttcttcgccctccgacaccttggcaatcagcttttcgcgcagggtgaccggaacgccttgggtgtccgtgtcaaccacgaagctcccattagactgggtggtccccaaccgttgttcagccactaaaacgtcctggaaggccgggcggttggtgataatctcaagggcgccggtaaaatcagcggggtgggtaacaaaggcaaccacttggtgcggattcttcttcaagcggtgcaagaccaggttcccccgccttgcccgggcgccgacttcgaggtcgctgaccgccatttccttgaaggcgccccgctgggtgaccagccctaagtggtccccgtcgccagccaaggagatccccaccagttggtcgtcctccttgaggttaatggcccgaaccccggcggtccgaaccccagtgaccggcacgtcttcaacggcaaaccgcagggcgtaaccctcccggctaatggcgagaacggactggccggcttgttcaggttcaaagtagtccacgctgacgacctgtgccccttcacgaagcttgatcgctaccgaggcgtgggtcttgtagcgcgaacccggttggtaatcacttagggcgctctgcttaacttgcccatcggaggtggcaaaaatgaaggtccctggtaagtcgagcttatccaacagcatggccttgacgattacctcatcgtcgtccaagtcaatcgtctgcgataggtgctcaccagtgtccttccaacgggcgtcggtcagttcgtgaaccggccggtaaataaagcggccctggttggtaaacatgtagaggtggctcagggtggtcgtttgctccaagaggagtgggtaatcgtcttcccgtaacccgttatctcccacttcagaggccttaaaggaacgaatcgacgagcgcttgatgtagccagccgccgacactaaaacgatcacgtcttcatcggcgaccgtcacccgggtgtcaacagtcaacttctggacggtgtcctcgatctgggtccgccgtgggttggcaaattcctttttgatcgcctgcatctcccgtttcaagacccggtccaaggttttttcgtccgtcaggatccgcttgaagttttcgattcgctcggttaacttggcttgctcttgttctaaggcggtaacgtcggtgttggtcaaccggtagagttgcaaggcgacaatcgcttctgcctgcgtcggggtaaagtcgtaggccgccaccaagttttgctgggcgtccttgcggttcttggaggcccggatggtcgcaatcacctggtctaaaatcgacagggccttgattaaaccttcgacgatgtggaggcggctctgggcccgccgtaagtcgaagcgggtccggcgagtaatgacctccttttgaaaggcgaggtaagaagccaagtagtgctttagccccacccggaccggacgttggtcatcaatggccaccatgttgaagttgtaattgatttgcaggtcggtgtttttgagtaggtagttcaagaccccctgggcatcaacgcctcgcttgagctcaatggcgatccttaacccggtccggtcggtttcgtcgcgggcgtcggcaatcccctcgacctttttgtttaagcgcaggtcggtgatccgcttcattaactgagccttattgacttcgtaggggatttcggtcaccacgatttgttcccggcccccgcgaagggtttcgatgctggttttagcccgcacaactactcgtccgcgtccggtttcgtaagccttcttgatcccgtcttttccttgaataatcgccccggtcggaaaatccggtccgggaacaaacttcattaggtcatcgaggctggcagccgggtgggccaacaggtaaattaaagcgtcgattaattcgcctaggttatgggtgggaatttcggtggcgtacccggcggaaatcccggtcgccccgttgacgaagaggttggggatccgggcgggtaaaacgaccggttccttttcggtgtcgtcaaagttcaaagtcatttcaacggtgtctttgtcaatgtcttcgagcatccgcccggcgatctttgataagcgggcctcggtgtagcgcatggcggcagccgggtcaccgtccattgacccgttattcccgtgcatttcaattaaaggttcccgtaacttccagtcctgacttaaccggactagggcctcgtagatcgatgaatcaccgtgggggtggaagttccccatcacgttcccgaccgacttggccgacttgcgaaagcccttatcgtaagtattgccatccttgttcatggcaaacaggatccggcgctgaaccggcttgagcccatcgcgaatatcggggagggcccgttcttgaatgatggacttagagtagcggccaaagcggtcgcccataatttgttcgagggttaattcttcaatgcgtgtatcagccactggcgtcatcctttctttactcgttccaagtcgtcaccgtggggctcacttggcccttagcttccactaaggcatccgcttcttggtcgtcgctaatggtgaagtggacattttgatcgatccactcccgccgcggttcaaccttgttacccattagagtggtaattcgcttttcggctaattcggcgtcttcaatccgcacccgaatcagggtcctggtttccgggttcatcgtcgtctcccataattggtcggcgttcatttcccccagccccttaaagcgctgcaaagacgtccccttgctgccctttttggtcaacttagtcagttcatcattggtccaagcgtaggtgatcttggtgtttttaccgcgccctttttgtaggcggtacagaggtggcatggcaatgtagacccgccctgcttcaatcattggccgcatgtacttgtaaaagaaggtcaataagaggatttggatgtgggcgccgtcgtcgtcggcatcggtcataatgatgatcttgtcgtaattagcgtcttcaaccttaaattcggttccaaccccggccccgaccgtgtaaatgatcgtgttaagctcctcgtttttcatcacgtcatcgagcttggccttttcggtgtttaagaccttcccgcgcagtggtaggatggcttggaacttgcggtcccgcccctgcttggcactcccaccggccgaatccccttcgactaagaacagctcgtttttggcgctgtttttagattgggcgggggttaacttgccggacaagttacgctccttgcgtcccttacgcttgccagaccgggactggttgcgggccttacgggctgcttcccgggcttgccgggcccgtaaggcttttttaattagtgactgggcgaggtcactgttttccatcagggcgtagcctaactgttcggacacgatcgtatcaacaatcttgcgcgcctctggcgtccctaacttccccttggtttgcccctcaaactgcaggatccgctccggaatccggacggaaacaacggcggtcagcccctctcggacgtcggtcccctccaggttcttatcgcgctcctttaaaagccccaccttgcgggcgtaatcgttaaaggttttggtccaagcaccacggaaaccgacctcgtgggtcccaccacccggggtacggacgttgttgacgaagctcagtaggttttcggtgtacccatcgttgtactgggcggccacgtcgacttcgaccccgtcttgggtgccggtaaaggaaaagaccttcccgagggtgtccttatcttcgttgaggtaggccacgaagtcttcaatcccgtttgcaaactgaaagacctcttcttgctcccttccttcccgcttgtcggtcagggtgatcttaacccccttgagtaagaaggcggactcgcgcaggcgccttgccaaggtttggtagtcgtaaacggtggtcgaaaagatcgtgggatccggtttaaaggtgaccgtggttcccgatccttcccgggtcttgcccagttcctttagggtgccgattggttgaccaccgtcacgaaacttctcttggtagcggacgtggtcccgcacgatcgttagggttaacttcgaagacagggcgttaactacggaggccccgaccccgtgcaggcccccggagctcttgtagccatccgcttggccgaatttccccccggcgtgaaggatggtcatgatgacttccggggtgggcttgccgctttcgtgcatccccactggcatcccccgcccatggtcttgcaccgtaatggcgttgtctggttcaatcgtcacgttgatctcgtcaccaaaaccggacagggcttcatcgacggcgttatcaacgatttcgtacactaggtggtgaagcccgtgggcatcggtcgagccaatgtacatccctggccgcttgcgaaccgcctccagtcccttcaggattttgatcgaggatgcgtcgtacttgtattcttcttgtgccacaaaggggccccctcacattttggatttgcatttttgcattcgattttttatcatagctaactccggccgcaatttcaaatcatcttttgaattgaccagccggcgcccagctgaattacacttaattagtgtagcacaccccgcccattttaatcaaacacccgttcccttatggtcgaacctagtaaaaggtgctatgataggtgagctataattcaaaggagcgtctgtatgctaaaaattattctgatggtcgttattgcctatttactgggctcaatcccctcggggctttggatcggccaacacttctataataaagacatccgccagttaggcagtggtaacattggcaccaccaatacctaccgggtcctcggccccaaggcgggaacggtggtcttagtcatggacattttaaaggggaccttggcggctagccaaccctacctcttccacagcaacatcaaccctttgttgattgggatctttgcttcccttggtcacacggtttcgatcttcgaccacttccacggcggcaaagccgtggccacctcggctgggatcctcttggcctacaatccgccaatgtttctcctggcctccgccatcttcgtagcggtgttgctaatcacctcgatggcttcggcagcctcaatcattgggattaccagcatcttcgtgatcgccctggtgatgcacgactatatcttagcgaccgtggctggtattttaacggcggtggtcatttaccgccaccgcagcaacatcaaccggatcatccacggccaagaatcgatggtttccttcggcctgggccactacctcaagaaccgcaagtagactggcaattgaaaagaccttctcctaggtgtttccctgggcagaaggtctttttttagttactgatttaaaagggacggatgctgaattggtagttggcaacgcctcccggagctaactggttcatggccggcttatgggtcaattgaccgtcactatcaaccccatcggctaagccccaccacggttcgatgcacaagaagttcccggtgttagggtattgcgaccaaacccccacgaaggggttgccactggtgagcaccgtaaccccgtggccgctctccggttcggttagggttaaggacaggtcggcaccataaggggcgaaaactaaggcgtcatggtcaaagaggtcgtggtttaactgaattggccgccgggcgtccagttccttggggtgaccaaggtcgctgtatggccccaccaaaggaatttgggggtaaactttagccgggtcagccgtcaaagtcgccgtttcaaactgaccagccgccgttaacggaacgttgaatcccgggtgggcccccaaagcgtagcgtaatacctgctcacttgcggggttagccacctggtagctgatcactaactgatcttccaccaaagcgtaagtgatcgtcaggcggaattcaaaggggtaaacggtccgtgtttgttcatcgctttctaactcaaaaaccgctaaatcagcggcctggttaaccagtttaaattcccgaccgcgggcaaagccatgctgggtttggtgaaaatctcgtccttcaaagccgtagtgatcatctttcaaacgccctacgaagggaaacaggaccggggcctggcgtgaccaggactgggcgtccccttgccacaagtactcagtgtcctcaccccgccgcttaatgctgtgcatctgcgcccccagggggtcaatttggaccattaaacgctcgtttgtgatcgtaatcatcgttgctcttcctctctagaaatactgttgatacttcttcttcaaatcctgaacctgcccttgttggtaacccgccgtggccactagggtcttatggcccgccaaccggttggcgtcttccaggcgttgttctaacacgaccttgttcaaataggcatggcgtaggttcgcgggcgtggcgcctccgctaacccggcggacggttcgttcaacccaagaacggctaaccggtttcccattcgccaacgtcagcacccgttccctgaccgtcggtggcgtcgcataagccgcttctaactggcttaataagcctaacaggtcatcaggcaagggaacgtagcgctcggtttggtcctcgcctttaatcaggaccattttcatggttacgtccacctgcccccaacatagggcgattagctcgcccgttcgcatgccagtttcgattaccaagtaggtgacgacccgttctaagagggtcgcccgcttgctgttttgctcgatcgattccatcaacaattggtagttgggcaggttgcccctggcaccaccgacctcgtcaaattggatcccgaccaggggattttggtccaccaacccctgctccagtaagtagtggtaaaaccggcggagggtcgtggcctgataacgggtagtggccacgctaaccccctctttttgccggcgaatgaaaaaggcgcgaatttgggcggtcgaaaggtggacccaccccggccactcgccctggtaagaccggcgaacaaagttgaggttgcgaccgtaccccgcgatggttgatgcggcgagtcgtctttcctgttcctttaaaaaggccgcttctaattcttcatccattaccaaatgatcccctcccgacaaaactttaaaaaaattataacatagtaaatatcgcaagaaaatcggaaatggaaaccctttcgtaaaaatcgtctaaaaacgcccaccatcttaggcaggcgtcaattagattatttttgaacttcttccttataatccccgtttggacagaggacttgcttgccccccttgacctttttttcaaccaagaagtgcccatcctttgggcagtcgcgaccaattggccggtcccaagacaggaagtcacagtccgggtaccgagaacaaccgtaaaagacccggttcttcttggacttacgttccaccaccgttccctggtggcaaagtgggcattcgaccccggtgtctttaacgatcgccttggtgttacggcagttcggaaagcgggaacaagcgtaaaacttaccgtacttccccatcttaatgaccatcggggcaccacaaatctcgcaattggacccggctagttcatccttcatctcaatcttagccacctgctcttcggccgtggccacttcctttgagaacggcttgtagaagccatcaacgacttgcacccagttctccttgccctcttcgatcttatcaagtgagtcttccacctcggcggtaaacttgacgttgacgatgtccgggaaatgcttggtaatcaaatcgttaacgatttccccaagttcagttggttcaaagtgacgagattctagcttgacgtagtagcggcgttggatcgtatctaaggttggcgcgtaggtggacgggcgcccaaccccgttttcttccagcgtcttaaccagggcggcttcggtgaagcgagccggtggctgggtgaaatgttgggccggattgtcggcgaccatcttgacggcgtcgccctcttctaggttaggtaagatattatccttaccctggctccccttgtagaccttagtaaaaccatcaaacttaaccttcgacccgttggcacggaagtcgaccccattttgggtgatggtgacggccatcgtgtccgtcacttgcggggtcatctgactggcgacaaagcgcgaccagatcaggttgtagagtttgtattggtcaggggtcaaaaactccttcatctcggccggggtccggttaactgaggtcggccgaattgcttcgtgggcatcttgggccccttcttgtagcttccccttgaccggcttggtggcggcgtattccgccccgtagtgttcgtggatgaaagtggaagcctcgtgcttagccaccccagcaatccgggtggagtcggtccgcatgtaggtaattagcccaacggcggcgccctggccgatgttaatcccttcgtacagttgttgggcggccatcatcgttttacgggtccggaagtttaaacggcggttggcatcctgttgcattgtcgaggtggtaaacggtggttgcggcatccggcgccgttcccgccggtcaactttggtaattgaaaagtcctgctggcggtcgagttgttgtagaaccgcttggacggcttcttggttcttcaggttggccttcttaccgttttggccgtagaagctcgcttggaacttttctcggccctttttgaagtcggcgtcaatcgtccagtattcttcgggaacgaaattccgaatctcgttttcgcgctggatgatgaggttcaaggcgacggattgcacccgccccgccgacaggccctttttaacctttttccagaggattggcgaaatcgagtaccccactaagcggtcgagcacccggcgggcctgctgagcgtccactaggtccatgttaatcgtgcgaggttctttaaaggcctctttaacggcatccttggtgatttcgtggaaggtgacccggttcttttcggtcgggtccatcttcaagaggttcgccacgtgccaagcgatggcttccccttcccggtccgggtcggaagccaggtagacggccttggccgccttggcgtccttgcgcaattccttaatcacgtcccccttaccccggatcgaaatgtaatcgggttggtaatcgtggtcgatatcgacccccatccgcgacttggggaggtcgcggacatggccgaggcttgcgacgaccttgtaagtccgtccgaggtacttaccaatcgtcttggccttggaaggcgattcaacgatgaccagcttcttttggttagtccggctaactttgcgccgggtggtttttttctttgttgtgctttcttgtttagttgccaaactcatcggctcctgtcatttaataatctattccatttattattaatgcacgggcgccctgctgtcaaatgaaagatgcaaagttaaactaagcttcggcttcaaaccaggggtcaaactccgctaacaagtccttgctgtttaagattggttgcgccccttcactaattaattcgttggtgccaagcgaggtcgggctggtaatggggccggggaccgcacaaacattgcggttctcctgcagggctaagttagcggtgatcaaactgccactctgctgctttgcttccaccaccaaacaagtttggcaaagcccggcgatgatccgattgcgggcgggaaagtggctcggcaagggcggggtttgcagggggtactcggttaacaagaggccttggtcggccacttgggcctgcaaggcaccgtttgatcgggggtaagtttggtccaggccggtcccgatcaccccgatcacggcgcccccgcttgccagggcctgctcgtgactccgcgaatcgatccccctcgccagccccgacacaatggcaatccggtggttaacgacgctgggaatcagtttctctaagacggtgaagccgtagctagttgcctgacgagacccgaccaccgccagggccggcattttgaataggtcccggttgccctggtagtacaaaaccaggggtgggcagtagatttcccgtaagattgctgggtaatcgggatccagcagggtaatttgggggacccggtaattttgttcaaccaaccggtccaaataggggctcgcccagttttttagcaagctttccttgacccgtggtgtaatctgcgactggctggtgagtaattccaaattgtcaaagcagtagttttgctcggcgactcgccacaggcgcacccggcttaacggaccgaggccgggacagaggcttaagcgaaagataaattctcgtggttgcataaaaaattcctccctactgttaagtacggaggaatcggtaatggtgacgaaattaattgacgtaatctggcaccggtcggaaggtccgccggtggatcgtgcaggcccccagctgctctaagccagctaggtgggccgccgtgccgtagcccatgttgtccttaaagccgtagccgggatacagacgatcgtaaattgccatcaggtggtcccggtactccttagccacaatcgaggcggctgccaccgagatgctcttttgatcccccttgattaacgtcgtttggggtaccggaatgtctaacgggaccgcatcgacaatcaggtggctgggctggtggtggagtgctttgaccgagcgaatcatcgccgcctgggtggccgcatagatgttaagctggtcaatttcttgagccggactgaccgctagggaaacctcaacggcttcatcgaggatccgcaggtacaactgttcgcgctcgtggcggcttaactgctttgaatcggtcacgccaactaggtcaaactggctgtctaagaccacggcgcaagtcaccaccgggccagccagtgggccacgcccgacctcgtcgattccggcgacgtactggtgaccggcctgccaaagctggttttcgtagcggaagcggttcaaaaaggcggcccgcgcctcggcccttttttccagccgcttggcgaactggtttaacgcggcctgaacgcccttacgcgggtcgtccttgaactctgccagtcgggggtcctggggatcggtgattgatgaaagcaacgccctgacctgggccaccgattgcttactcatcttcgtcccccgcttccaaatcggtggggtcttcaagggtaaaggtccccaatttaccccgccgcatttcaaaaatcagccgctcgctggcccggtcgtaatcgtctttcatccccattttcttggtgatttctaacaacaggtctggggtggtcacaccgtcttcaagactagccgggctcaaccggtagcgggtcatgagctcttgggtacggtgggcccgtaagtaatccagggcaaagatcgccacgtcgtctttagggtacagcgagtccttgatcgccccggacagggccaacatcttggcctgggtttgggtggcaaacttaggccataagaccccgggggtgtctaacagttccaagtcggccgaggaacgtagccattgttggccggtcgtcacccctggccggttcccggtcgcggcaacgttttttttcaccaagtggttgagcaaggtggacttaccaacgttgggaaccccgacgcacatcgcccggatcgcccgcttttgcatcccctttgctcgctcggcggccaactggtcctttagaatctgttgggcctttacggtcacctgtttagcaacctggtgggccctggaatcgagcgccaagaccggttgaccgttttgttcaaagtagtcgatccagtgggccgttgtcgtcgggtcggccaggtcggttttggtcatgattaacaggcggggtttgtcgccggccatccggtcaatctccgggttttgcgttgaatacggaacgcgggcgtcgaccagttcaaagacgatgtcgactaagggcatttgttctttaatttggcgcagggccttggccatatggccggggaaccattgaatagttgccatgttgtgtaactcctttcgtagcaaggatttcaagctcttgctctgataaattttcttaatggtaccacttttgtgccatgtgtcccgttgctggtaccatattattagcattttatcggtaatagctgaactttgtttacaccggttgaagactaataccaaccttcctagcgaacgtatcaattacttcaaccgacttttcttgtgaatgtgaaaggcggtgcgtatagccatcagtcgtccgttcttcaacgtgaccgactcgctcttgcacttctttcaacgttacagaggaatcatcacgcaagacggagatatgaatgtgtcggaaactatgtggcactggattttttgtccatttgaagccatagcgtttttcacaattcttttccaagtctgctttaattctgccaagtacttcacgaaaactatgtgacgtgatcggtgaaccgtactcggtccgaaaaatcacttgaaattcatgaaaagcatcactcggtaattccttcatccgcctatcaaatacggcattacggtgtatcgcacgcttcaatgcagcaatcgcaaaatcaggtaactgctccacccgttcgccagcaaccgttttgacggtatcttcgtagtactcatcaacccgtaagtcatgtgattgcatggaactagaaatcgtaactgtttttttagcaaaatcgatcttatcagatgttaaccctgatgcttcaccaattcggcaacctgttgcaatcataaatagtgccagatcatagtacgccggattgcggcgttgtgccaattcagtgaacaagactttgacctcacgcgaatcaagaaacttactttccaagcgatccttccgctcgattttttcagtcgttgtcgcttttaaatgcagaacggctgtcggtgaagctggaatgatgttatatagcaccgcatggtcgaaaagtttattgaaagttgatttgatgtgttgcatggtggcaaaactagcgctgtatttttcgcgatagtcttgcaaacatttattgactaacataggcgtgatgttttttaccaaaatatcgtctgcaataatttgattcaaccgcctaataacaagcgcctcgcgcttaattgtcattggtttaacagactgtttccacaaatcaaaccaatcttcgcgtaaatctttgaacgtccatttttgaacgcgctcatcaagtgcttgagctcgctgtgaagttagctcttcgatcttttcatcaagttctcgcgccgcttgtgctttacctctttgagaattagacttaaaacttactgaggcccgtttccgtttgccagttaaggggtcaatataattctcgaaaacgcgataagttgaagttccgtcagcgagtactcttttttgaaaatgcataattttatcctccaattcaaattaataaacaggaaagataaaatgagattaaatagctatttcattttaccatgtcccggcggtgttgtcagacgtttcggatgtaatgatgctgtttccaaaacaagaattcttgaaaggtcgcaaagttgatcaatacaattttgtgtgtaggattaataacgccctgacgaaaagtagcgtcattacgcatttccgacaaccaccgatttaatgtataaatatttagaccctcatagcgtttcaacaatgcttgcttggttccccattccgctttaccggcggagtcgccactatatggtacacttgtattttccattttttcacttcctaatttctagatgaagtgagataataatcgtagatagattgcttattttatctattttaaggtgtaactacttgctttggtcggcgtagttgcatctttttattatctcaatcgccattatgtttgggttgctgaatcattatttcttcgggactagccaacatttgttgaatcatcacttgttgattttcacttaacttggcctcagcaatgatcgtcattagagtatcctcgcttttagccgaatcaattgccattaacatttttaaacttggcgccacttgtttcttgatccattgaatagtttggtctaaagtgaccggttccggcgaaacggccaaacgtaactcatcggcatatttaccaataaactgtgcccaccgatcgtccaacggccattttgacgttggcttgttggcaatcggcttcacaaaacgcaagtaattattgataataccgaacacggttcgctgcgggttgcgataggccaatagatcggcgaccgtttgctcagcccgttcgtcaaacacacgaatctcaaatcgattcttgattttggtctccgccaacgctttacctaatttaaaatattgctcaatatctttctgataaatacaaaaataaattgcacttttacgtgagccaaaatagagactttctccttttaaattgtctttgtcgcggacaaagtatttacactccctgaactttgtaatgtattcatgacgcatactctttttaatcaagtaatgaaccgggagcacatctaaataatcattgatggctagatcaatgcgtttaactacgccatcaagggccagtgcctgccgtaaaaagtcataccagctctgttcactggccactaaaatgccttccagttcgcgacaacctttccccttcaactcaatcaatgaaccgcgattatcgtcttccggtgaaacaaaaatttccatatcgccatgccgaaattttccactgtagccataacggccataaggttcataaacaaaataaatcggcttgatgcagaaaagtgccacgatcaattcgtcaacatcatgggttggaaatctgatccggacatagtcaaaacaaatgtttaatgcggtgatgccactcagttcgcaaaaggctgcggttaatcgttggcgcatggcctcagttaatggtcgcttactgttcaatagttgattgagataagaacgactgatgcccattgacttagctagctgactttgcttaatttttttatcctccaactgttgccaaaaaatattaagccaatcagcttggacctggtaatcaattagagttaaatcttcattcaagtacgctcacctccaaaatttgcaattcttagtcacggttaacagcaactttgttgcttgaatacctagaaattggcatttcttgctgctggattaattaaccgtttatactttctacccccctattagaacttgggggttgaggcggccggctaaagccgaccgccgctcacgctagcggctttcgcgttgcacgccgcgcgtggcggcggctaatcttttttcctcctttattctgttttcaaggaacgattatgatcaatgccagcaaaaatttgtaagaatatttcacttggcttagatcatataaacatgataacgtaggcctttagagctggtcaatcaccttatgccacctactcaaagaccgtgagtagtcgttgtagttgtctactttaagtaactaagttaagataatcatgaggtgatgataatgatcgaaaactttggtcaaaacataaaaagattgcggcaaaaacaccagatcacgcaagaagacttagccattgccatcgaagttcaaaaacaagcaatttcaaatattgaacgcggtaaaagttatcctagttttgaaaacttggaccgaattgccagatttttcaatgtttccgccgtcgacttatttggcacaccggctgaaattgaaatcagtagcactactgctattcttgatcgcattgatgaatatactgacaaaactgagcacctctttcgcttaatgcaccgcatagatgatttttcaccgcgtcaaattgatggtcttagtgatcaagttcatgaaattatgagctattttcaaccctacacaaaaatcaatgaagatggtaccccagagactgataacaatgatcgaccgatcgtccgccaatcaaaatatcggcaattaccaattaaaaaaatcaatgccttatacaataaaatcaataccatcaatgcttatcaccaaacgcaaaaaaatcaccttcaaaagaagatgatcaatgaatgataaaaaatatcgactactgcttaattaaaataatagctgcataatatgcctaatagtgttactttcaagaatgatcatgatgcctaaaccaatataaataatggccatgatccaatcaccaaaacgatcaagaaagttctttacaaaattcacttgtgagaacttatcaccaaggaaaactaaaaaataaatacaaatggtaaaaacaaacagcgttacgattagctgtaccagtgataatgatacgaagtaaggaacaaaaaggccaatattatccgcaccacaagaagctaccgtaattaaagccaccgttgcaattaaattcttatttttacgcgcttcaattttctgatcaacttctgcggcttcatcttctttgctaaatatatatttgattccaaaggcaatgggaatcaaccctaaaaaacctagtaaccatttggcgggtacgtaatggagaataaatgcaaaaaacaaactaattccaatgagcgtatatgagcctaagaactgaccaatataaatttgtcggcgatgctttgttgaacgatattttgaaaaaagtaacattaaaataactaataagtcgattgcagttgatgtataaagaataatactcgttataattgtcctgatcattttattttcccccaccagcattgatttttccggcatcttcagctaaacaccatgcccgttctaataaaattgccgtacattcatcaatgatctgatattcaatgaagttgccattacgcttcgctttaactatcttttgatctactagacgttgtaactggtttgagatggcttggaccttcatatttagtgatgtagcaatctcactaacggccatatctggttcacgcgttaagcaatgtaaaattcttagccgcgtattatttgcgagtactttaaaaagtaaagcaatgtcagcggcttgattctcatttaacaatgcccgatcagccaaatctggtttacccggacaacagtctacttgtatcattagatcactcctcgtttattaatctattacactatatcatgtaatagtgttgtcccccaatttaatttgaatcaaaaaatagagtagctcctatagccactctatctgacattaaccactattcatattcactagtccggccaatatttattaaactaaacacccgatcaaaaaatagctgaagagcaacgtctaaacaacgtcgtcttcaactattttttattgaccattcgtgtacttgccgcttaggttcttttggatcttggcgggggctttgtcgtaggcgaccaccttaactagcttaccacgcatcaacaagcgtcgggccccggtggcgtcacaggtcaccagggtgaggatattttccttagtgttatcgatcacgtcaacccgggtggcgtcaataaactttcgctcgtacaacttatactcgtaaacctttttcatatcggtgatgtagaccaactggccgaccttaccgtggtagtaaagaggcgaaaagaggatcttagagccgttagccatgttgtgagcggccagtgggtagttgcccttccccatttcttgatcggcccgcatcgttccggccgctagcgccaaggtcgtgttagaaactcccttggcaatcgggatccgcaggttgatcgccgggatcgagatcaccccgatcacgttaattgattccttcttggcccgggccgcggccaccgtctgtagattcaagtccttgacgctgctgaaatcgtaactggcctttttcttctcgttttttgccaccagcgacttggtcacctgtggttgataagtgttaaccaggtaatctttaacctgctgattaaagatcaagaccaggctgagggcaagccccaaaatgatcactaaccagtacaaggtggttttccaccatcgtttctttttcatcatgccctcccgtcagtgttaaaatatcaaagtcagtatacactatgtcagaagggaatggtacgaattggtatcatcgcgtcgccccgtctgggttcgcaacctgcgggtcctttcagtgggcgttttctttgccggaatggggttttctgaggtgacccccttcctttctttatacattgccaccctcggtcacttcagccaccagcagctgaacttcttttccggactatccttttaggcgatgtacttcgtttccgcctttatctcccccgtctggggacggttagcggaccgctacgggcgcaaaccgatgtgcctgcgcgccgccctgggaatggcaatcgttttgggggcgatggggttagtcaccaacgtctggcaactgattgggctacggatggtccagggggtctttgccgctttcatttccaactccaacgccctgatcgccaccgagacccccaaggaaaagagtggtggcgccatcggggtaatagccgctggggcgaccggttttgttttcatcaacctgtccctctttttcgtcaacgtcttcttgcccccacgcaaggcgaaccactaaaattaagaccacgctccgtcggccaggccgcaaaggggggtggtctttttttgttcgccacgcaccgtggttagtttgttaatcagggcgttgccgattcaacaaaaaaaacgccccaccgaagtgagacgctttaacgaaggttggtttacttgaaaccgtacttcttgttgaacttgtcgactgccccgtcggcctgggtgaacttttgcttcccagtgtagaacgggtgggagtcggacgtaacttcaacccggacaagcgggtattcgttaccatcttcccattcaacggtttccttggaagtagccgttgaaccggagataaacttgtaaccagttgctgagtcttcgaagactaccaagtggtaatctgggtgaattccttgcttcataatttaatacgctccttttgccatgaatcattgcctgaaacatagttatttcaataaccctaatagagtaacacgtgctcagtcaaaaagcaacctagtcttgctcatcgtcttcaatccggacgttggcgtttagacgattgagcttccaaacaatgcggtcgtaaccacgtaggatgttgtcggccttgtggataacggtttgaccgtctgccattaacccggtaatcaccagggaagccccggcccgaatttcaccggcctcaacgtcagcgccgttaaagtgatcggtgtgctcgatcgtaatctttccgtcgccggctgcgatcttcatccccatcttttgcaattcggggatgtgcttgacccgcttaggatagatcgtatccaccaccgtgcttaccccggcggccttggccatcaacggggtcaacggttgttgtaagtcggtagcaaagcccgggtacggcatcgtcttaacgtgaaccgccgttaagtgctccgccttaggcacgtagatcttatcggaatcgatcttcaaatcaacccccatttcgatcaacttactagtgtaggcttccaagtgttcagggatgacgttattgatcatcaccccatcgcccatggcggccgcaagggaaaggtaggtgccggattcaatccggtccgcaatgatcgtgtgcgtgttcatcgattgcagggagttcaccccggtaatccgaatcacgtcggtcccgaccccgcggatctgcgcccccatgttattcaaaaaggtggcaaggtccacaatctctggttcccgggcggcgttttcgataatcgttaccccttcggcacggaccgccgccaagatggcgttgatcgtggcccccacggacaccatgtccatgaagatccgcgttccgtgcaggccatttggtgcctccaagtggacggtcccgttgttttcactaacggtagcacccagggcttcaaaggcctttaagtgttggtcgatcggccgggggccaatgttatcgcccccggggaaggttaaggttgcccggtggaagcggccgagtagcgctcccataaagtaatacgatgcccgcaaactcttaatggccttgctaggcagttcggcttcaatgatttgagttgggtcaatgtctaacaccccgtgcttaaaggaagagtgcacgttcattgactctaagataatcataagattgtgaacatccaggatgtccggcacagtatcaaactggacgggagtatcggccaggatcgccgatggaatgagcgcgacggtgctattcttggcgccaccgatcgttacttcgcccgagagtcggttccctccttgaatgatcatttttttcatgattaggtatcctcgcttttaaacatttcatttcatttgatgaggaccgttttggcgttaaaacagtcaatattcatgataatgaaactggccctaaattacaagcatttcccgggattcttaacctttttacccaccgacatttcccaacgccaagcaccatttcccgccttttcccgggaaatggttcgcctttcagccgctaatggactagtccgctgccgcagccttaacaaaggcggcaaataatccttccggacggttaggccgggagaggaattctgggtggtattgggcggcaacgaagaacttgttttccggtagttctaccacttcgaccaggtttcggtccgggttcaccccagaaacgaccaggccgtggtcttccatttcctgccggaaggcgttgttaaattcgtaacggtgccggtggcgttcggaaatcatttcctggttaccgtacgcagcggccgctaccgtccccggcttcagttggcattggtaagcacctaaacgttgggttccccccatgtcttccacgtcttcttgatcggccatcaggtcaatgatgttgtgcttagtgtcttgatcaaattcggttgagttcgcatcttggtagcccaaaacgttccgggcgtattcgatgcaggccacttgcatccccaagcagatccccatgtacggtacgtcttgttcgcgggcgtacttgatggcggtaatcatcccttcgatcccgcggctcccgaaaccacccggcactaagatcccatcatagtcctttaaggtttctgccacgttgtcttcggtgatgttttcggcgttaaagtggtcaatcttaaccttggcgtcaaccgggtagccggcgtggcgcagcgattcgttaaccgaaatgtaggcgtcttgtaagtcagtgtacttaccaaccatggcaatcttgaccgtcttcgtcaggccgttttcgatgtggtccaccatcttggtccactcgcccatgtcggcttttggcacgtccaagccgaagtgatcaactaccagttggtccatcccttgcttttgcaggttcaacggcacttcgtaaaggttcttggcgtccattgattcgacgaccgcctttggttccacgtcacagaagagggcgatcttagtccgcatgtcatcggtgattggttcttcggtccgcaccaccaggatgttgggctggatccccaagccgcgcagttcgcgaacggagtgttgggttggcttagtcttcatttcaccggcggcctttaagtacggcactaaggtcgtgtgaatgtacaagacgttgtctgcgcccgcctcttttttcatctggcgaattgcttccatgaacggttgggattcaatgtcaccaacggtcccaccgatttcggtaatcacgacctcggcgtcggttgattccccggcccggcgaatcttttccttgatcatgttggtgatgtgtgggatcacctgaacggtccgtcccaggtagtccccgcgccgttccttacgcaaaacctcggagtaaatcttcccggtcgtcacgttggagtacttgttcaagtcgttgtcaatgaaccgttcgtagtgccccaagtcaaggtcagtttcagtcccgtcgttggtcacgaagacttccccgtgttggtatgggctcatcgtccccgggtccacgttaatgtagggatcaaacttttggatggcgatctttaagccacggttctttaacagccgacccaatgaggccgccacgatccccttaccaagggatgaaacaaccccaccagttacaaaaatatacttcgtcatatgctctctcctttacgcatgccggggttacaacaataaaaacggctccctatttcacgtgaaacagggagccgttcatttttaaactcagtgtcccaaatctttgggagcccaagtaaaataatacgaaaacaaccataattagtcaaggcaattgttaaagcaattattcctcgtcgtcttctttatcttcttcgtcctcttcttcatcgtcgccgaattcgtcgccgtgaagctcagacagttgatcttcgatgttggtttcctcgtcatcatcttcaacggggttatcctcatcgtagtcgtcttcttcgtaatcgtcgtcatcgtctggaccttgatcatcatccagatcttcatcttctggatcatcgttgtcgtagtcgatcacatcgtcgtcgtcgtcagttcctgccaagaaggcattgaccttgcgccggcgcttctttggccgatcttcttcgtcttcggtttcaccaaccgttgcttcatcgatcgattcgtacgggtaccaggcacgcaggccccaggtgttatcaccaagggaaataaagctgccatcgacgttcaggtccgtgtaaaactgcgagagtcgttcccgaatttcctcgtcacttttaccaaggtattgttgaatctcgttggtcaagtcggcaaacgccattgcctcattatggtaagctaagattgcgtgagccacttcgatcattgaaagttctgatttttcctggccatcgaaaacctttaaatccaaattggtgcacttcccttcaaaaagtctaaattacatagtatcatatcacgcttcgaaccgcaattcaatttggtaggttcccactaattggtcacccgccgttaactggtaggccaagtgtaaactaccactggcccggggccaatttaattcggcgaccaattcgtcggtaatgaccgtcagctgaatgatcccatagggggtgtggtaacggctggtggtcttcgtttcgcggtcaaaggtcaggcgggttttaaccggcccgttgcgggtcaactgaatggcgccatcacctaaacgaaattgcaccggggtggcttgccccgcctggtgttccgtgtagcgcaggtagcgttgcccgtttgctagggtcaccagttgaccatcttcttcaaactggtagctttcttcttgcccatcctgggccattcgggtggttaaacggacccgaactggtattacttcactcatagtgccctccctttcccccctatcttaacagttcttggtttacccgtcatctattcggcaactttaccacaatcatgtataatgggggcattgacaacgtcacagggaggaatcatgacatttcaagatgaagcactaccccgggagaagaccttccgtgacccgatcctggggaccataattgttgataaccaaattatcctcgacctcatcaacacgccggagtttcagcgtctacggcggattaagcagttggggactagttctttaacctttcacggcgccgagcactcgcgttttggccactgcctaggggtctacgaaattgcccgccggatgtgcaaccattttcaacgcaactaccccactcaccaccccggcgatgggctttgggatgattccgagcgaccggtcgccttatgcgcggccctcttacacgacctcggccacggtccgtactcacacaccttcgagcacatcttccacaccgaccacgaggagattacccgccgcctcattaccagccccaccaccaacatccaacggatcttagcccgggtcgccccggatctccccgcccaggtggctagcgtcatcgatcatacctatcacaaccagcaagtagtccagatgatctctagccaggtcgacgccgaccggatggactacctacaacgcgacgcctattacaccggcaccaactacggtaagttcgacctcgaccgggtcttatcggtgatgcggcccatccaaggtgggatcgcctttgaaatctccgggatgcacgcggtcgaagactacatcatctcccgcctgcaaatgtacttgcagatttacttccacccggtttcccggtcgatggaagtcatcttagaccacttgctcaagcgggccaagtacctctaccaacaccctaacgattaccagccgacctttaccccctacatgctgatgccctttttcaacaaccggttcaccctggatgactacctctccttagatgatggggtcttatcgacctacttcatccactggaccaaaagtgaagacgacatcttagccgacctggcccggcgctttttaaaccggcgccccttcaagtccgccctttacgacaaccagaccggcgccatgctagagaagctgaccgacctgatcgctacggcgggctttaacgccgagtactacacggccactaactcatcgtacaagttgccttacgatacctaccacccgcaaagcagtaaaccccaatcccagatcgaactaattcaaccaaacggcgagttagttgagctcactgaggtgtcaactttggtggcggcaattgccgggcgccaagccggtgacgagcgcttctttttccccaaggagatgctggccgaacacgacaacatcgaaatctttgagccgatctaccaagagtttcaacactacatttctaacaaccacatcatcattcccgactaaggaggcagaccatgtccattaaattaatcgccattgacattgacggcaccctgatcaacgaccaattagaaatcaccgaaaagaccaaggagaccctgcaaaaagccaccgcccaaggcatcaaggtggttttgtgtacggggcggcccatgaccggggtccacaagtacttggatcaactcggcatcaacaacttagctgatcagtacgtaatttctttcaacggggccctggcccaaaccacctccgggcaggtaatttcccaattcaccctcccctttgaaaaactcgtcgacctctccgccgttgccctcaaagcggacgtccacctcctggccgaaaccgccgacgcgatgtatgtcttaaaccaagacatcagttcctacgccgtttacgaatcgagcctggtttccttgccgatcacctacaagtccattgaccagttaaacaccatcaaaaacgacttagttatttccaagctgatgatcaccgatgaaccagccgccattgatggctttagcgctaaactaacggcgcccattaagcgggcctttaacatcgtccgctccgaaccttactacctggaattcgttaacccgtcggctagcaagggggcggcgctggcttccctaggccaggaactgggggtcgcccgtaccgaaatgatggcgattggtaacgcccaaaacgacgaatcgatgatcacctacgccggcatcggggtggcaatgagcaactcgatcccgtcgacgattcaactggccgacgaactggtcgccgacaataaccacgacggggtcgccgaggccgtcgagaagtttgccttggcttaaaggaagtggaaactgacctccgaagcagcccggatgactaagctaggacggagattggtgcgccacgcaccgtttatttaaatgagaccaaaaaaaatagctggatatcacgttttttaacgttgatcttcagctatttttggttcattgattagggaagttggtttcccaatcattaagaaatcttcgttacgctacccatctcggcgttgtattcgtaaatcccgatcaggttagccaccgtgttgtcctggttattttgccgcacttcaaagcggtaaacgctcccgttcttttgaaccgggataatgccgtatccttgttggttaaagcccatcttagtggcaaaggcgtcaatcacgtcttcgctcgtgctttgggccacggatgcgttggctgcggaactgctggagctactagtagctgccgcggttgtcgcactcgttgctgaagaagtggcactagaactcgtggtcgagctgcttgattcagccgccgcaatcttactccgcaggctctggtaagcttccttaatggccgaggagctggaagaagccgtattcaggttcgtcagggcttgatcgtagttgccgttgttgtaggcctttttagccgcaatgtagttttgaaggtcggtggcaagggcgcgactttcactcgtggacttagtaacgctgttcacttcgtccaaggcttgttggtacttgccctgttcaatcaacttttctgccgcggcgatcttgtcggccgccgtgaccgtcttttttgaactggtcgaggagctctcattcgttgaactgctggacgaagagctggctcccttgctaccacaagcagcaaggcttaacaccgttgccaaggcggcggtgccgaccattgccttcttgaaaaagcttctgttcatcttatttcctcctttgtcttgtcacattataccattcctcacccaatctaacattgttgatcgaaaggaaaagggggcgtgaccacctggccacgccccctgtgctaacttatttttcaatattttcttgccggaaacggttattaaacaggggactaactgcgcgattttcgttaattcgtttgatagcatcggcaattaacggtgccaccgaaacctgcctaatctttgtaatttgtttttcttctggtaggcgaatcgtgtcggtcaccaccacttccttgagcggggagttggccaaccgttcgattgccggaccagacaagacggcgtgggtacaagaagcgtaaacctcttcggctccggcgtcaattagggcctgagaccccttggaaatcgtaccggccgtgtcgatcatgtcgtcaatcatgatgcacttcttgcccttaacgttcccaatgatgttcataatttgggcaacgttggccttcgggcgccgcttatcaatgatggcaatcggcgccttcaagaattcggccagggcccgggcccgggtcaccccaccgtggtccggtgaaacaacaacggtcttgtcagccaccccttcgcgaatgaagtagtcggctaacagcggggcacccatcaagtggtcgacggggatgtcaaagaacccttggatctgggcggcgtgcaagtcgagtgccaccacccggtcaaccccggaattttggagcatgttggccaccaacttggccgtgattggttcacgggagcgggccttgcggtcttgacgtgcgtaaccgtagtacgggagtaccacgttgatcgtgttagcgctggcccggcgcagggcatcgactaagatcaggagctccatcaaattgtcgttgaccggggccgacgtcgattggatcacgtagacgttatcgccccgaatactctcttcaatgttaatttgaatttcgccgtcactaaaacggtccacggaaagctttcccagttccaccccaacgtaggcggcaattttttccgctaacggccggttggagctgagggaaaaaatctttaatttagggtcaaaataacgttctttcattaggtcctccgatatcgtaaagatcttaactcatcactttttatgatagttattccccccctaaaaagcaagctcttaccaggggagttttttggcgtaacccggcttattgacttggcgggcgcgggcaatcgccatatcaaattgttcggtgctgtccgtgatggtggaaccggcggccacaaaggaatcggcggcgatgttgaccggcgccacaatgttggagttagaaccgataaaggcgtgatccccaacgttggtgtggagcttgttggtgccgtcgtaattgacgaagacaaccccgcagcctacgttgatgtttttacccaaggtagcgtcgccaatgtaggacaggtgaccgaccttggttccggctccaatgtaggcctttttgacctcgcagaaattaccgacgtggacgttttcgcctagttcggcttccggacgcaggtgactgtttggtcccacgtcagccccggagtggacctctgacctttccagggtcgaagacatgatggtcacgtcatcgtgtaaggtgctgtcttcaatccgcgaaccggcgccaatcaagcagtcggccccgatcgtcgtccgccccttgatgaccacgttcccttcaatgaccgtgtcttggccgatttgtacgtcggtatcgatgtaggccgtttcaggatccaccagggtcaccccatccttcatcagctgggtgttgatccgcttttgcataatcttagtggctttggcaagggcgctccggtcgttaacccccattgactcatcaaagtcttccatttggtaggcggtaacgatttcgccttcctcctttaagatcccgattacgtcggttaggtagtattccccctgggcgttatcgttggtcaagcgcttgagggccgcaaaaagcttttggttatcgaagcagtagaccccggtgttgatttcgtggatggcctgttcttcaacgctggcgtctttttgttcgacgatccgttccacaatcccaatttcgttgcggacgatccgcccgtaaccggttgggtccggtgccttggaagttaagatcgttacggccgcgtggcgttgttcgtggtattggaagaggtggttgaaggtcgccgccgtaaataagggggtgtccccggaaaccaccagggtctgaccagctaattcacctagcaggtcttctgtttgcatcaccgcgtgcccggtccccagttgttgcttttgtaaggcgtagcgcacttgatcacccaaggcgtctttaacggtgtcggcaccgtaaccaaccacggtcacgatgttttggatgtcggccgcttgcagttgggtcaagacgtgctccaccatcgtcttaccacaaacctggtgtaagaccttgtggagcttggacttcatccgggttcccttcccggctgccagaataattgcgttcttgtttaccatcgttgccatcctttcttagtcttggtccccaaacaccttggccaggtaattccccggttgggcgctaatcttcttgttaacgccgtcctcggccgtcaccttgatcaaggaggtgcagtcttctactaagcgttggccggagaattgaccctcggcaaagacggtcatcccaattaagtgggcgccgaattcgttgatcagggattgcatcccgttgagggttcccccaccctttaagaagtcgtcgacgatcaccacgttggccccttccttgagggtccggcgggaaagttccatcttcttaatccgttgcgatgaccccgacacgtagttcaccgacacggttgacccctcggtgatgtgtgacgagttccgcacgatcacaaacggcttgtttaaatacatcgccacgctctgggcgatcggaattcccttggtttccacggtcataaccacgtccacgtccttatcgacgtactgggtggccaccaagcgaccaacttcgcggaggatttccggacgccctaacaagtcggacaagtaaacgtagcccccaggcaggagccgggaatcgtcgttaacggctgccactagctcatcaataacccgggtggcgttttcctcggcgtacagtggcgtcaaacgtgcaccaccagaagcacctggtagggtttctaaacggccgatcccccaatcagctaaggtggtccggataatgcttaagtcttcagaaatcgaggacttagccgagccgtaacgttccccaaagtacttcagggataccaattcacgggggtgttcgagcaggtagcgcgtcatgtcaaccagccggttactacgtcttactttcatcttcttacctctttacttgatgctggtcaacctggccagcgaattttgggtcttcctaagtgatttaccttgccataataccataattgttcgtcttttgcctaattattatcaaaaattacccaacgttaaacgatttatccgaaaaataaaaaaagccattccgaacatggttcggaatggctttttttaagttactgatattagaaagcacccgtggtcacttaagcaaccacccggtggtgatagtaaagggcgctgacgtagattacgacttcaatcacggcgatgaaaaacgagatcggccagttagtgacgtagcccaggtaaaggcccaaccaggtccccaacagggcaaataaaatcgctaagccgatcatcttggcggtcccggtggcgtagtacttagccgcggccgccgggagggttaagaggataaagattagcagggagcccacgatctgggccgccacggaaacggacagggcgaccaggattaaaaaggttaccgacacgagcgttccgttgaccccgttaacccgggcccccaccggatcaaaggaatcaaacttgaggcgccggtacatgagaaagaccaccgccaggactaacagcgacaataagaccagctgccacacttcccgcttggaaatccccaccaccgaaccaaagaggatgctcgtcgctgagctagccgtttggttagacagggataaaaagaggatccccaacccgataaacagggccgaaaccgccgaaatcacagcttcgcgccgggattctttaatgctcatctgcccgaccattaccgacgacagcatggtaaacaagagcatcccgtttagggcctgccagccggcaaaaacggcaaacgaggccccggcaaagccaatttcagacagggtgtgggtcaaaaacgacatccgccgggcgaccacaaagaccccgatcactcccgatacgatcgcaatgaaggtcgaagcaataaaggcgtaacgcataaatgacagttcaaacattattcttcctcctcgcccatcggtagttcgctgattggtccgctcgtcgcctgccccgcttctaggtgtaagtaacgggtcccatagtggcgagcaagttcccaatcatgggtgacaaagaggacggcccctcccttggcccggaagtcttccaccaggtcaagcaagtcgtacttcatttcgttatcgaggctggccgttgattcatctaaaatcaagagttgcgggtcggctaacagggcctgagccaagtaggcccgttgcttttcgccccccgacgccataccgagtggccggtcggcaatccgggtcaggtcggtcgcggccacaatttgcttaaccctttgccgctccgttcggttcaaccacggtatccggttggtcggtaagtttagggccacaaaattgcgaaccgacagggggtattcgctatccaagttccggaactgggggacgtagccgatcttgatgtctgaagccagcttgatctggccctggcggggctttaattgccctaacaaggagcggaccatcgtcgtcttcccgaccccgttttcccccacaacgactaaaaagtcacccgggttaacctgaaaattcaggcccgtaatgacttctttatcgccgtaagctagtgttaagttttcgacgtttacaattgggataattattcacctcgttggattttaagcaaggcttggtattgcttggtcatccaagaaacgtagtcctccccgtctggttcggattcagttacgtttaagaccggaacgttgttttccttggctaacttaaccaggttttccaccgttttgccgctttcttggctgttgttaacaaagaaggcgatccggtggttggtaatgtcatcttggatttgttggatgtcctttggtgacggatcactgtcatcttcaacggccttttcaaagtgttggtcattgatttggtaacccaagttttccaaggcgtaatcgaagaccggttcgctaacgtccactaagcggttatcgcccacgttttgcttggcttgtgcaattaccttgtcgagcttttgtaatttggcttggtaagccttggcgtttttttcgtagtcggccttgtggtcgggatccagcttgctaaattgcttggctaaggtggtggccaaagtgctcatcgttgccgggcggtaccaaacgtgttcgttagcaccgtctttttccttggcgacttgttcaccgacgttaatcagggtgatcttgttcttgctgtcggccttgaccatcttactcatccaagcgtcgtaacccagcccgttttcaatcgccacgttagcgatggcaacctgcttggcctgcttggtcgttggttggaactcgtggggttcaacggccgaactgttaataaaggaggtcaccgtcccgtgatccccagccacggccttggctacttctccgtagaagttcaggctcgtcaccacgcggattggcttttggtgggacttagacgggctccaccccgtcaccattaagcccacgattacggcgaggacgaccacaagcgccccaattccccagtattttcgcttcatcacaaaatcctccagtcttatttcccattaaatcgtaatccttacgattaagactgaagaataataactggtctgggtcaaaatggcaagcctttttttaaaaaagttaaactctttgcctaacacgtggaaaccccgggcagtttttcacgtagcgcccagggtttggcagttcagttataacaagacgacttggtagacctccgggcaaaagccacgcaggctgttataaatgcgcttggcccgtgattcggcgtggcacaaggcgaagacactgggaccagtcccgctcatctgtgccacgtcggcccctaatttttgcatccgttcctttaaacgggcgatttcggggtgggcctccatggtcaccgcctctagggcgttacccatgtactgaaagctctcctgaaactttccttccttgatggcttccaccagctggtccgtttgcgggtggaccaaacgctcgtaattaatctggcgtaagataaccggggtcgagactgatagcttgggtttggcaatcaccacccagtagtggggaaaggccggcaggggttccacgatctccccgtggccggtcacgtgggccgtttgggagtacacgcaaaatggcacgtcggaatcgattgataaggataagcgcgccaactcgtctaacgataaaccaaggcgccaggccttattgagggcccgcaagacggccgccgcgtccgaagacccgccaccgaggccggccgccaccggaatcttctttttgattcggatggtaaccccatcagtctggtgaaagcgggtctttaggatgtgggcggcttggtaggctaggttgcgttggtcattgggtaaaaaaccgctgttggtgtaaaccttgatcgtctgtggtcggtggtgaatctccacggtgacgtaatcagccaggtcaacggcgttcatcaccatgttccagcggggcaggccgtcaaggtagcgcatgggcgtatcgagggccaagttaatcttggccggtgccttttccgtcacgatcattccacagtccccctttcgactcagtttgcccttaattatactaattctcgctaattgacgcaaaaggtatgaggaaagccgccaagtcattcgctcggggcaagggtgagcgccgcctgcggtactctgtcatccgtcatccccgcggttagtgacggcaaaaagaggccggggaaaacgtgttttctccggcctcttactatacattcgaacattagacagcaagctaccacctaagttcgcgatgcttgcaattgtcagggaaactcttccccacttttatagcaattccttttcgtgcatggcgttcgctaagttgatgaagtccaccaggctcaagcgttccggccgggtttgagaatcgatttccaaccggtccaggacttcttttaccttccctaggcggtcctcgtccttgccgacgatcgtcttaaggttgttccacaagctcttgcggcggtgggcaaagcagccccgaatcaggccaaagaggcggtcctcgttaaagggggacaccggcagggccgcactcttttgcgtcaaaacgacaatcgccgagtcaacgttgggggctggtacaaaggacttgcgtgagacgttaaaggcgactttgacgtccatccggtagtcgatcgccaaggtcagggcgccgtagtccttagttcccggcttggccaccaggcgatcggcgacctctttttgcatcatcacgcaaaccgccgcccactccacttggctggctaagagggcaaacagaatcgggctggtgatgtaatacggtaggttagcgaccaccttgactggcttggtcgggtccttaaaggccgtctgaaccagatcggctaggttggccttcaaaacgtcttggtttaaaaccgttacgttgccgtagggggctaacacgtcgtctaacaccggcaggaggctttcgtcgatttctaaggcaaccacttcgccggccgcttgggccagcttttcggtcagggccccgattccgggcccgatctcgattacgttatcgtctttggtaataccagccgcccgcacgattccactcaagacgtcggggttggtcaaaaagttctggccaaagcccttcttagcgtggataccgtactggttcataatggcgcgggtccgcgagggactcccgatttgcttactcatgcgttttcccttcctgatcaagttgtgcaaccgcccgttcaaaggtcggccggtcaatggcaaagaggtcgaggcgcttcaatagttgcttagcgttgccatagccaatccccagcaattcacctaggcgctcccggcgcctcttggccaccggactccccgccaagcccgccttaatgaggtcctggttgctaaaggtgggggttaaaacgggagtggtggtgtagacgttttgcagggccgccaagatggtcgccgagcttgcgtgttcaacccccaggctcccgtgggcctcggttggcaccccctggtcgcgccggatgaaggcgtgtttgacgccgggaacgttttggtcgatcagcttacggagccgttcgccgttaaaatcgggatcggtgaagacgatcaccccccggctttgctggagtttttttatttgttcaagcgccttttttgacagggcggagccgttcgtttcaaaggtgtcggccaacacggctcgttgcacctgcttggtgtcgtctttaccctccaccacaattacttctttaatcttgtccattatgtcctttcaaaaaccggtttgtcgcggtctgcaacgtcgctgaggccacctcttctacggagcgttgcaagagtttggccagcgcttcgaccacaaagtaggtgaaggcgggctcgttttgcttcccccggtacggaaccggggtcaggtagggtgcgtccgtttctaccatcatccgctccaaaggggttaccttggcggcttcgtgaacttccgttgccttggtaaaggagaccaccccgctgtaggagaggtcaaagtccaggtcaaggaacttttccgcccacgctgcgtcaccgctaaaggagtgcatcacgccccccgctttaaccgggtgctccactaggacccggtatgtttcggccagggcctcgcggcagtggatcaccaccggtaagcttagctggttagccaggtcaatttgttcaactagggcggcttcttgggcccggtggtcggcgattccgttaacaaagtctaagccgacttcgcccacccccacaacctcgggacgtcgcaacgccttttttagcccctcccaatcggtcggggttacttccgctaggtcctcggggtgaaagccaattacggcgtgcaagcccgggtaggtgctagctagtttaagggcgcggtcgtttaacagccggttggagccaatcatgttcagctcggtaaccccgtaatgtttagcccgggccaaaaaggcccctacgtcaccgtaaaaggcctcatcgtttaagtgggtgtgcgaatcgtaaatcttaatcgtcattgcttagcagaccgttgagccaacttccaggctgtctggaactaacactagttgtacctggccgtttaattcagaggataagagcatcccctggctaatttcaccacggagcttgcggggagccaggttggccacgaagacgaccttcttacccaccagttcttccggtactgggtaccacttagcgatcccggacaggatttggcgcccgcccatgccgtcgtcgagggtgaacttcagcaacttatcagcgcccttcaccttgccggcttccttaatcaagccgacccgcaggtccaccttgtcaaagtcgtcaaactggatttcggctttgactgggtcaacgctagcagtcttggccgcttccatggccttgcgccccttttgcttttcgttggcactcatttgggacttaatgaagtcgacttcttcttggatgtcgcgccgtgggaagatcggcgttcccttttcaaccaccactacttcggccgggaagtcattaaaggagaggtcagagagggaaatggcttccttggctaggcccagttggcccaggatttccttgggtgccgttggcatgattggttgcagcatggccgctaccatccgcaatgacttggccaggtgggtcaaaacatcgcttaagacgggtgcttgttgttcatccttggccaagacccacggttcggtttcgtcaatgtacttgttggcccgggcgatcaacttccagatggcggacagggcgtcggcaaagcgggtctgatccatcaattcccggtattccaccagggcgtcttgggccacttgctctaagtcagcatcaaagtcggtcgtggcccctggttgacccaccaacttgccggcttggtacttgttgaccatcgccacggtccggttcaagaggttccccaggtcgttagccaggtcgtagttaaccttttcgacgaagtcttccggtgagaagaccccgtcatttccaaacggcatcgcccgtaacaggtagtaacgggtggcgtctaagccgtaacggtcaatcagggtttctgggtaaaccacgttccccttggacttggacatcttgccgtccttcatcgtcaaccagccgtggccgatgacgtgcttaggcagtggcaagcccagggcgtggagtatgattggccagtaaatggtgtggaaccggataatctctttaccaaccatgtgaacgtcggctggccagtacttcttaaagaggctgtcgtcgtcgctgccgtagcccagggcggtaatatagttggataaggcgtcgatccacacgtagaccacgtgcttcgggtcgtttggcaccttgaccccccagttaaaggaggtccgggttacggccaggtcctctaagcctggttccaagaagttcttaaccatttcgttcatccgcgattctggctggatgaagtcggggtgggccttatagtagtccatcagccaatcggcgtacttgctcatcttaaagaagtaggactcttctttcaccagttgaacttcgtggccagacggggcaatcccaccggttacctggccgttttcgtccttgaagacttccttgagttggctttcggtgaagtactcttcgtcatcgaccgagtaccagcccacgtattcgcccttgtagatatctccttggtcgaggagttgttggaagatcttttgaacggcggcttcgtggtagccatcggtggtgcggataaacttgtcgttggtgatttccagtttttgccacagttccttgataccagccgccatttcatcgacgtaggtttgcggatccttacctaatttttcggccttttgttcaatctttagcccgtgttcgtccgtcccggttaaaaagaacacgtcaaaaccactgagccgcttgaagcgggcctcggcgtcacaggcaaccgtcgtgtaggagttaccgatgtgaagtcgtccggatgggtaatagattggtgttgtgatgtagtaggttggttgttcagccatacagcgggacctcttttccgataatcgttttttcgttaacttccagtatagcaaaaagccacgccgatttcgaaccaaactggcgcaaaaccgcgtgacttcaaaagagttctagttgggtcgggtcctgtttggtcaggcccgtaaagtgtaaatccatttgccggctgagggcgacggcgttgtcggccgcatcgccccccgagttgttgttaaagatgacgcaagtttcttttggttgcggctgttgttcttgaattgcttgggccaggtcggttagttcgctcgccgagtatcggtacagggtccgcttgccccgccagtccttgcccccggcctgccagccggcttggttgcgcccgtgcaggcggatcagggttaggtgcggcgtcgtagtagtcaagaaaaagggaattccgccctgggtttggtggggttcatcggcggccaccagggtcagctttaggtcacggcaataattgaccagtgcatcgcccactcccgattggtaccaggaacggttacgcaactcgacggcgaccggcaggttccccatcagttcccgcaccgtgcgtaggtactcgatgtgttcggtccgggcgtcaaagtagggtggaaactggaagaggaccgttttaagctgaccggtgctaactaacggcgccacgacctgtttgaactgggtgaagacggcctgggggccgccaacggcttcctggtgtccggtcatcacctggtgggccttaacgataaactgaaagcccggggccacgtcggttagccacttttgcaccgtcatgagctggggcagggcgtaaaagaaggtatcaacctcgaccaccggaaagtgttggccgtactcctttaaggtcgttttcttgcgggcgttgttaatcaaactggggtgttcgctccaggtcgtcaagccaacggtgaccttcatttcaatcccctccttttagtgtatcttgcgccaatccagcttcgtttgcaagcgcctaggccctaaagcggcgccggacggcgaaggtcaacacccaggccactaacagaaaggcaattaccacccagtaagggtacaggtagttgcgatccaacaaggccccggccattagcggcccaatcacgttaccgacgctagttaaggacatgttcatcccgttaatcaagccctggttgtcttcccccaggtcggtcaacagggtggtaatcgccgggcgtaagaggtcaaaggcttcaaagacgaccagggtcgctaaggtaatttgccaagcgatgccgtcgtaaatgacaaagaccgtcccgaccgccgctagcaagtaggcccagcgaaccaagcgcaactccccaagccacttaaccatcgcttcaaagcaaaagacctgcaggaccaaggaaatgattccgtttaaggtcaagaccaaggcgatttggcccaggtcaaagccgtgcacctggttgacgtacagcgagtaaatcgcctcaaacccggccaacccgaaggcggccactaaaatcatcaagaagagcaggctcacggttggcgaccaaatctcctttaacgccgtcatcgtcgacttctcctggcggtgttcttcgtggtgggtaacccccaccttttcatcgctaggcaaccaaatggcggccacgatcgtcgaaataatccctaacactccggccacccagaagggtaacttgaagttgtcggcggccaaaattccaccaatcccggggcccaagatcagcccgccggaaaaagaggccgacagccagccgattaccttagcccgctgcgccggggtggtgatgtcggcggctagggccatcgaggttggaacaaacatcgccgccgccaacccgtcaatcgcccgtgaggtattaaaggcggccagcgagttacaggccgcaaacaagaactcggcaccggcaaagatgcctaagccccaaaccagcatctgcttgcgcccccacttatccgaaacccgaccgaccaccggtgaggccacgaattggactagggcaaagagggcggccatcacccccatgtcaaaggccgataggtggtaagcctgtttgatcgccggctccaccgggaaaatcaggctcatccccaaacaaatcaaaaattggcacaccaacatgatgttgatggtgcgcttcaccactctagtcatttaaacctccgcaattaattttctgaatctcaatttagacgaaaaaggggctgggaaaatttcctagcctcttttggatttttaagtgttacataaaaagcgtcgtcgacaacccgcctagtgcctaagtacgggcaaagaacggcgccaaggcaccaacctttgccctagcttagtcatacggcctgtttgatagattgggtcgcacttactctttaccgaacctctagctgcccaaagaagtccgtggcgtcagccaccaccatttcaaagttgcccggcaactccagcggctcctggttaacggccaggatcttaacccccggcttggcgtattccaacaagctagcaaaggggtaaaccttcatcgaggtccccaccaccacaatcaggtcggcctcttgcatggcggccaaggactggtttatcgccacctgggaaattccctcgtcatacaagacgatgttagggcgcagcggtccttggtcaagcttgtgcaggcgactagttaggtactcttcaactggcacgtgggcgccacatttttcgcagtagacgtcaaataggttgccgtgaaagtcgactaagcgcttggtcccggccagctcgtacaggttatcgatgttttgggtgatcaccgttgccttatcgagcttggtgtaggcagcctgcttttcgtgaatcacgttcggcttggcgtccgggaagtaaaggttatccttgcaaaactggtaaaacccttccggatcgctttgaaaatagcggtggctcaagaagtactctgcgttttggttttgtttgtacagcccgttggccgagcgaaagtcgggaatccccgaggcggtcgaaacccccgccccggtcaaaaagacgatctggtgggcctgatcaaacaaggcttgttgttctagcatggttatccctcccgaacggtgtacggaaagccgcgtttctccaaaaattcttgtacgggttcagcgtagagcttgacgaattcggccgggctgtttttctccggcatcgggatgacaaaggagttttgcccgtcgccgcgccgtaagccggcgtaggcatccccctggttaccctttaactgcatgtcggagcggtaaatttcaaagacctgcttaacttccagccgtaattgacgctcggacaagaccggggtcacggtcgtgtaacgctggttgtttaagaccggcaacccccaactacgcatctgttcgtcaaccagcttaaagaggttaacgatcgtgcgccgggtttcccacggcgtttccattggccggttgaagagcttagcttgccactccttcgccacggaaagggcgtaggggtagttggcgaccaactctttttcaaccgcagccaggtgctcgccgtaaaaggtcagggcgtcaaagaggttaatcacccgcaccagggtgttcatcttctggtccgcactagctagcgggtcggcgtcctcctttggcagggcgtcctttaaccccattaagtactcttgttcaatttggtcgttaatcaggccgcgcttgcgttgttcggccacgatcaagcggtgcatcaccgcgtcatacaggccggtggcaaacatccgcgactgatcgtctaaatcctcgtcaccccaagttaggttgaagagcacctgcgggtattgcttgagggtgtagtaaaggtgcaagagctcgtgggaagccgtgtagttgggctccgtcaggtcgctgacttggaccaccatcatccccggtacctgctttaggttggcctggtcgtggcgaacaaagccactcttgtcaccagtgaagtcaacgtggaccatccctaaggggtacaaggcatcgacttcgtccaacaattccttaactggtgctgatagttcaatcttctcttctgccatcgtgtgcttcctttctgagttgggccagcagttcgctagctacctgccgatcagcgtatcccgccgccgctaactgcttagcgaggacgggcgcctcggcggttgtcgctcccacgctaagtgctagggagcggtactggagtttcatgtgccccgcttggataccggtggtggccagggcccgcaaggccgctaagttttgggccaagcccccggcaacgattacacccgccagttccttggcactcttaatttgcgatatttggtaattgacctgggattggggagtcagcttgatcgaaccgccaaccacgccgatcggcattggcagggttagctccccgaccaggcggccgtccttaaattgccaggtcgccagcccccggtagtggccgtctttggcggcgtaagcatgggcgccggcttcgattgcccgccagtcgttaccgctagcgaggaccagggcgtcgatcccgttcatgatccccttgttgtgggtggtggcccggtaaacgtccacctgggccaggtcactcatcaaggcaatccgcttggccaccgtcaccccgtccatttcgctcgtggccaggtgggccggatcgatttgacaggtcaccgtctgtaagctgtcggtggctaggttgcttaagatggcggtgaggacctggtagccctgctcctttagccaggcgccaaccgcttcggccatcgtgttgaccgaattggcccccatcgcctcggagacgtcgatcaagaggtcgaggctaacaaagggtggttcaatccgtacccggatccctttggctccggcgccccgtttttgcatcgacgggtgggcgtcattggccaccgccaggattggttcctggtggtccagcagccagtccttggtggcgccaaagtctaccacgtcacacaagacgacttgccccaccagcgcccggggccctgccgtggctacaaagccgccgctcttggcaacccgctggctaccgttgctagcggcggcaatcaccgatggctcctcggtgaccattggcaggatgtagtcttggccgttgaccactaacccgaccaagaggccctcgggcaggtggtagtcggttaggtagttttccaccagttgatcgccgagctgggtggcttggttggctagggtttgggcttgctgatcactaagggcgctcgcttgtttaaccaagctacgccgttcctgcgcactccgcttgtaaaaaccgtgggtccagtccttagccattttgctcccccttctgccgtttttgaatgtactcggtaatgatcccttcccgcacgccggattccgagaaaattacccgcccgtcgctattacgttgcaacaagcacaccaggggtaacatccccccaatgatgatgtcggcgcggtcggcctctagtcccggcatcttcttgcgttgggctaggttacggttcaatagctcccggtaggtgccgtacaccaccttggacgacagccggtagccgtgaaaggaattcccgtgctggcgccggtgggcgtaggtcatccgggctagggtccggttggccccgcccaacaagacgatcggtacccgggtggcgtagcgcaaccacgggatcttgttgaagcgctccatgaccattgactgggcacggaagaggtcgtcggcccgtacgaagccgcccaggtggtactgttccgacaggttaaccgccccaaacggcagcgagattaggtcgcgggccttcttgtgttgaacgaggatcaactcgctactggcaccgcccacgtctaaaatcaggcagtggctcagttttaaagtgcgcaccacccctaggtagtcgtagtaggcctccttgcgcccggacagcacctgaaattccaggccggtctcttttttgacccggtccaaaaactcgcggcggttttttgcttggcggacggccgccgtggtgatcgcccgcacctgcaggttgggcaaaccctgataaagtcgcttgaaccgttttaaggccgcaatcgtgtgttcaattgcttgcggttggaggatcttctccgttcccattccctcggacaagcgggtgttttccttgacccgcttgatctcccgaaagtccccgttgtcggcaatttccgtgattgccatgcggacggaattagagcccaggtcaacaatcgccaggttttccacgactcatcaccccccttttcaatttttgtttttttcgtaatgtttatccctcttatgttaccatttttcaaccgggggcaacacggataatcccccacaaattaaattctcacccggccaaagttaactagcagatttctgttaattgatgggtaccgagtgctacaatggattgacaattttttatttggggggtcatttggtgactgaactaacggaacaacaacgagaacaagcgcgggtggatacggtaatcaaggaaatcgaccgccaaattgaaggggccaaacaagcactagcggccgcccaccaagaaacccgggcggtggagcaaaactacagcgaaaacgcctcaattaaccgctacgaaatcgacgacattgccgaatcacggtccgaaatcgaacaacagcgccaactggtggcccgggccagcgaaaacgaaaccatcctggctcaccaactggacaccctaaaacagttgcgggcccaaccctactttggccgcatcgacattcaagacccggggcaagcagaagccgagtccctgtacattggcacggcctctttaatgaatgaggaccggaccgactttttgatttacgattggcgcgccccgattgccggggtgtattacaacggcaccctgggcccggtaacttaccaaaccccggccggcacccaacggacgaccctggttaaaaagcgccagttcaccatccatgacggccagattgaaaacatgtttgacaccaatgaaacggtcggcgacgccatgctgcaagcggccctggggcggcaaaacgatcagacgatgcaaaacatcgtcgccacgatccaaaaggaacaaaacgacatcattcgaaacaccaccgccgatttgatggtggtccaaggggtggccggctccgggaagacctcggcgatcctccagcggattgcttacctgctctaccacgcccgtgaatcgctgaacgccgaccaaatcgtcctcttctcacccaacctcttgttctcccactacatcgcttcggtcctgccctcgcttggtgaacgtaacatgcgccaggtaaccctgcctaacttcttagcccgccgctttgaagggctacaagttgaatcactctttgaccgctacgaaacccgccagcaatccaatgccccccacccggtagcggattggttggagggcgccgctagcatggccgccgtcaaggactacgtcgaccaactggccaacagccaagcccccctccagttcgccgacctgacctttgaagggcgcaccctgtttaccaaagaagcgatcgccagcatctatcaccaccaggtcgctaaaatgacggtggccgaccggctagttaaggtcaaaaacgccctgctccgccgccttcagcacctagctaccaccgaagccaagcgcgactgggtggccaaagagctcgacaccctgtccaaccaagagcttcacgccctctacggccaaaagacgatcgatgactttgcggatgaacaggcccaagccgcatacctagcccgccgctgggcgaaaaaacggctccgggtggtcgccgacgccatttacaacaactactttttggactttcacgccctctaccgccagttcctgcttcacttgcccctgaccggccccatcacggaagcagtgcaacagcaactggccaccgactttagtcacggcgttgaatttcaccggatcaagctagtccacaccgctcccttcttatacctgcgcgaccttttgaccggtggggggcaaaaccgcagtttccaatacgtcttcattgacgagatgcaagactactcgctggcgaccttgatctacctcaagcacgccttcccggacgctaagtttaccgtaattggcgacgccgagcaggccctcttcaaaccgctcgagttaccagaaaccctcttgaaccgggttggcgacgccctagcggctaagcacccccgcttaattgccctacgccgctcttaccggtccacctttgaaatcaccaccttcgccaaatccctgttgcccgacggcgatgaaatcaccgccttcgcccgccacggggacccggccaagcttcaggttcattacgggcaagcggcctggcaaaccggcttaatcaaggcggtccaagccatgcagcaacgatttcccaccgtcgccgttttgaccagggatcaagaagaggccagccaggtttaccaccacctctacggccaagtaactgacctgcaccgcctgagcgaagaagacagccagctccccagtggggtcttgatcttgccaatttacctggctaaggggctcgaattcgacggcgtggtgatcgctaacgtctcggccgcccacctcggcgaccaagctaccgggctcttgtacacgatggcgacccgagcgatgcacgccttgacgatgctaacgctagggccggtcacgcccgctttaaccggggcggccagccagtacttaaccattgacccccccacggaaccacaaagataaaaaagagcattccagccagctaggtcggaatgctcttttgctttaataagttacggggtggtgcagccgctttaaggcgtgctttaaaatgaagggcgccaagacagtcgccaacacaaccaccgtgatcacgtcggaatagtacttagacgacaggaggtgggcctcgtacccaatctgggcggtgatcaaagccatttccccgcgggcaatcatcccgctcccaatcacgtaaccagactggcgatcaaagcccatcagcatggccccaccaccggaaccaatcaacttggtcaggcaggccaaaatcgtcattaccacgatgaagaccagtgagtccaagaagtggttcaggcgcatcaccagccccacgttgacgaagaaaaccgggatgaaaacggcgtagccaagcggctcgaaggcttcggcgatgtcgtggcgggccttggtgttagcaacggcaatcccggcaaaaaaggcccccactgccccgcttaggtgaactaggtcggccaacgaagccatccccaagcacaagatcattgccatcacggcgggggccgccgtcgtcaacaggcgcttgctcaagtgcatcaggtacggggctagccagcggaccagcaggtaggtcccgccaaagaagatcgcttgcatcataatgatcagcggcaggctggttgacgattcaccacccttaccgttcatcaaggagattaagacactcaggatcaaaaccccaccgatgtcatcggccacggccgctccgaggaccgtcgccccctccttgctgtcgatctggttaaactcgcgcaagacggccaccgaaatcgaaaccgaggtggccgagaaaatcaccccgataaagagtgactcaaaccactggaggccaaacaattgcgaggctaggcccatgactgcgatcggcagggccatcccccccaccgcgacggccatcgccggtttgaggtattttttcagcagtgacaggtcgctttccaacccggcgataaacattagaacgatcacgccgatctcttggaactcctcaatcattgcggtctggtgaatccaacccaaaacggccggccccgccacgatcccgactaaaatttggccgatcacgtctgggattccccagcggttaaagaagtgggaaaccagttgcgtaacgaataaaattcccgtgagcgttatgataaaagacatacaaaacctttctgacagactccaccgtacccaaaatttccttaatcaaaaaagacgcgaaggggcgcctttttttgttgcataattcatcataccagataatcttgtttgggtcaccaaacttggttgaaaagtagggttactacttttcaaggtacgagaggggtttattgacttccaccttagttccttggtacttctttttgatccattcctgaatttgctgattgtggtaaagcttaactaatttcaggtaggtctggttgtgagcgttcttcttggcggttgctaaaatattaatgttattcttcgtcgtttgatcgattttttcgtggtaaatcgaatcggttaagacgttcaagtgaccggtcaaggcgatcgtatttccgatcaatacggcatcgacagagtttaagacccgtggtccagtcgtatcatcaatctcttcgaacttgaaatggcgtggattagatgcaatctcgttagttccagacgtgacgccaaagcccttttttaaggtgatcaacccagcactttgtaacaagagcaatccacgagcggtgttagccggattattggcgatcgcaattgttgccccgtttggtaaatcgctaaccttcttgtatcgtttcgaataaattcccattggttctaagtaggtcgtccccaatgcagctaactgagcctttttattttgcttgttgtatgtctctaagtacgaccaagactgaaaggcattcacgtcaatttcaccactagccgttgccttattaaggccaatcggatcggtaaaggatttaacgttaatcttaatacccgctttcttagccgccttagactttgcgatgtgttgccagacctgaacgtccggtccaatcgacccgaccgttacggtgtgttgactgaccttactactagtggccaagtgtaaaccaaatgccgctaaaataataatcaagatggctactagccaccaccggtacttgcgcatcctcttttctcctccttaaaacaaaaaaatcccggaaaaggcacctgccttttccgggacgcactacttgagccgtgttaccacccgttttcagccccattgggaccctcaagcgccaccccaaccgggagggcgcaacgcaatagcggacgttaaccgtgatcaatttaccatgggctcaccgatcaaaacactcctggaccatcttcatcttttgtactgtcaccggctttcaccacctccggctcgcttcttgacatcctaaaaaactactcatccattcacagcatttcctcattcattgctcattattttaggagaacccctcccaattgtcaacattgtttcttactttttgtaattaaaaagccaggagaaccgttaccttctcccggctacattctgtaacaactcaaacgtcctgcccaatggttgattcgcacttctaataacgtgctcccaaccacgggcctagtgcctaagtacggccggagaacggtgcgttccgccccaacccccgtcctagcttagtccaacggcccgtcgaaaaggttagtcgcactttccctaagccacccgctggggttgaaccagctccttcatccttaccatgaatgacgctctacctattaagctacggtggctcctttagaataccaaaaagtcggggcgccggctagtttttgccccagtcgagtgccattccctgggcttggatggtggcggctagcttatccctggtcgtgtcgtgaacggccagcttggctccggaaatttgcttggtaaaggaatcgatccgccggttggcatcacgcaagtcgtagtaagtcgtgaccacttcgtcgtagtcctttagatcccccaccttaaagtcggttgggtagtgattttcaaaggcaatttggttttgtggcaaacgcggctttaattgcggttcttggtcgggaacccccacttgcaaccccaacaacggcagggtcatcttgggcatgttcaagaccttgaccagttcggccgggtcatctttgattgaaccgagcacgacgccccccagccccaggctttcggcggcggtcaggaagttttgcagggctaacaccgtgtcttcaacggcttggaagaagatgtcggtcgtgtgcaggcggccatcgtccttacccagctgctggcggatctgttggttacggtaaaggtcaacgacaaagacgaacagatccccgttagcaccaatgtacggctggccggagatgttccgaacaccctcacgcaaattttcgtcggtcacgtgcaggatcgaaaactgttgcataaacatcgacgtcgaggtttgactagcggcggcgtacagggtttgtagctgctctgcggtcaacgtttgatccttaaacttacggatcgaacggtggttggtaatttgatcaacaacgggattgtgtagcatggcaattcctcctcgtgcttactttttgttcattatgacggaattttccccgcctggcaagcgcttcctaggccaactcatcttcaatcgccgccagggtctcttcactgagccccttgcgcaagctaacgggaacaaagtggctgtcgactaaccgtaagtcgaggtccctggccacccggtcgcggtcgctggcgatcacgctcacccggcactggacggtggttaaccacttggccagggtggtcccgtttaaggagcgtaggagctgtttgaccggtttgggggtaaataacgatggcagcgccctgacggtcaggtcggccgttaagtggtagttgggggccaccaacaagaggcggtcaatgcgccccgattggctagcggctacccgcagacccaccaatgccccaaagccgttgcccaccaaggtgaccggctgttcggccgcgcgcaccagcgccgttatttgggcacttagttcttcaaattccgacgccccttctaagagcggttcgtaatcaaccacctgcttttggcggtggcccaccactaagtcctgccaggccgccgtggcctgccccagctccggtaaaataattacagttcccattttgaccccttctcaatcgcttaattgctctattttagcacatttgttctcccggtggtgggggtggtcggtagctttgcccaggccgctttcaagcggtccactaacggttgcacctgggtttggcgttgccgcttgacggtcacgtaaatcgtcagctccgctttgggccccttaattgatcgttccacccggttgttggctggcaccgggtgataggacgggtcggccgccgttacgttggtggtaaagtacggaaagctggagtagcgcgtgatttcgtccatggcgtcgcgttcgtcttggcacatgaagtgggcatcttcaatttctttgccaattacgtccttccacgccccgatgtcatcgaggactacaaaggacaatcccgccaggtcaaaatcccgaaccaaatcaatcagtacatggttgatccagttcgggatttcgttcaattcaattaaacagtggtgggtggccactcacctaaattattttgccgcttgggccttgcccttcttggcctttttagttggcttttcttcgaccaccggttcgtgaccgtattggaaggcttccccggtcaacacttcaaccggcttgaagaggccgataaagtcggcgtcaaccttgatgtgcttcttagcttcctcgtagaaaagggctctgattgcgtaaaccaccggcaggtaagccgtaattcccaaggcgatcagggcgtaacctaagtacatgaagaagtaggtcgccgtgtagatcccgtagtaagcaaccccgccaaagatggctgaccaaactacgatcggcaacagcaccaagacgatttgcaacaagaggaagttaaacttcagcccacccatgaagcggcggctggccgtcagggcgtggcgcatcgattgccccaggaagtctggttgcttttcccggtataaaagcgttgcttgcgagtattcgtaggacttccagatgatgatcaggtagttaaggatccggatcgtgtaaaccgcccaggtgtacttggaaacgaagctaccgacgatcgtcagcggcagggtccacaagaagatgaacaggccggtgtagaggctgatccgccacaattggttcttacgcaggtgcttgaaattcttccagatcgtgctagggctcaccaccacgtccgggtgttgaagccggtcttggtaggtgaagaccaccgccgtggaaatgaagttaaaccaaaagcctaacgctaagatcaaagcgaagaccccgagcagttccagcaaggctaacaaaatccccgacgtgctagccatcccgtacatcagcatcatcaagttcatgtacaaggtgctgacaaaggacaggtccacgtaaaccaaaagcgccgttaatgcgatgtagattaaaaagaacccacccgttggccacattgccttggtgtaccccggcttgaccaggtcctttagtttagccgtaaatgccttgagcggtacccgcgaaagtatattcattattgcaatctctcccctgtaaaaaaattattactttctatgataacagaacggggacgggcggtcaggtccttttacactttcctaactaaattgctataaaaggttcacttttaccggcgggcggcgcaatatttttgcaaacggtccagcgccgttttgatgacgtttaaatcggtggcgtaagagaagcggacgtacccttccccaccggcgccaaagtaagagcctggcgtgacggcgaccttcgccttttcggccaggttgtaagcgaacttctcgtcgtcttgttccaggtagtccggaatcttggcaaagatgtaaaaggcaccctccggattggtggtttcccagcccaactcctggagcccttgatacaagacgttgcggcgttcccggtactgggcccgcatagctgccgggtcctcttggccgttgcgtagcgcttcttcggcggcgtcttgtacgaaggttgccacgtcggtcacggcaaagccatggaccttaaagagctcatcggtgatcggctttggcgcacacatgtaggcgacccgccaaccggtcatggcgtaggacttggagaagccgttcaacaagatcgtttgttccggcaaggacttaacgatcgacgggtactgatccgctccttccgtgtaggcgagctggtcgtaaatttcgtcggcaattacgaaaattggcttgtcgcgcaccacgtcagcgatcgcatctagttcatcctggttcatggcgatcccggtcgggttagtggggttaaccacgactaagcccttgacccggtcgccgtattcatcgaggtaggactggatcaattcgggcgtcaggcggaagttggtcttggaagtatcaacttcaaccgccgtgcccccggcaatggcggcgtcggccatgtaaatcgagaaggtcggcgttgggaccagaatcacgtcgcccgggttggtgatcgccgtcaccgccgcgtaagcaccctcggttaccccgttggttaccaagatctcggtcgccgggtcgtacaccttgccaatctttttagccacgtcatcactaatcgccgacagcaaccccgccgtgccccgctgcggggagtagtgggtccggttgttagcgatcgcggccatcccggcctccttaacgtgttccggcgtgttaaagtccggttcgccgatggtcaattcaacgatcccttcgattgacttcgtgaaaaaggcaaagtcgaagatcttcatcgttgggacccgcttgaggtcggtgcgcatgtgctcttccattttcattaatcagtcctcctttattgattagagtttcattataattaaaaaattcacaaaaagcgataaatttatcaaaaaagaccgcccctattaaaggagcggcctcgtttacgttgattaaaaaagcttaatcaatgtcgtacttttccttgctgagcacgttcagcttttcatcgaagtcgtaaacgaccggttgaccagtagccatttccaagcccatgatgtcttcgtcggagatgttttcgatgtacttgctcaaggcacgcagggagttaccgtgggcggcgatgatcacgttcttgccgtccaagagctttggtgcgatttcgtcttgccaaagcgggattacccgttccagggtgaccttcaagttttccccacccggaatggcgcgtgggtccaagtcagcgtaacgacggtcctttgcggcagaaccttcgtcatcagcactcagcagcggcggcagcacgtcgtaagaacggcgccaaatgtgcacttgttcgtcaccgtacttttcagcggcgtcggccttgttcttgccttgcaatgccccgtagtgacgttcgttcaagcgccaagtcttgaattctgggatccacatttggtcggattcttccagtgcgtagtggagggtcttgattgcccgcttcaaaacagaagtgtaggcgtaatcaaattccagcccgtgttccttgatcgccttaccggcggcttttgcttgttcaacacccttttcgctcaggtcgacgtcaacccagccagtaaacaggttggacaggttccattcgctttgcccgtgacgaatcagtactaatttagccatgttcgtttgacctctttcttcttataaactttgcatacagcatacttctatattttaaatcagttcgccctaaatgaaaagtgaattgtagaacatggttaagcaccgttttttacaccgtcactaatccttgctagaaatgccgtaacagaattggagggctgagaacagtgcgtgccgcactaacccccgccctagcttagcccaacggcctgtcgaggaggttggtccgcacttccttaattaaacgccttttctccaatgtcttggcgccagaagcactccggttcctccagttggttgaggtaagcgtagacgtcttgttgggcctgctttaaatcactagccgtggcaatcaccatcaacagccggccccccgccccgtgtaagtcggctaaactaccggccacgttagcgtaatcgaccgtgatgttgccggccaccgggaacttgcccaacgcttggtttttgaccggcttttgcgggtaaccctttgaggccaccaccacccctaaaacggcgtcctctttttcaaccacttccggcaggggctggtcgttgacacaagcgtcaaccaggtcaaataaatcggttgctagccgcggcaagatcacttgggtctccgggtcacccaggcgaacgttatattcaatcaccttgggtccatcttcagtcagcatcaagccgatgtagaggatcccgtggtagtcgtactccccgtccacgagtcccttgacgcttggttccaccacttcttcgaccatccgttggcggtcgaattcactcaactggggcagcgggctgtaggcgcccatcccgccggtgttgggacccttatcgccatcgtaggcccgcttgtggtcctgggccatcggtaagatttggtagtcgccgttttcgatcaggacaaacatcgaatattccggtcccaccaaacactcttcaatcaccagccggccggtgtggtccgcaaacatttccttaatcgtcgcttcggcatcagcctggtcgctcgcaatcacgacccccttcccgccggcgaggccgtctaacttcaagacgaccgggaagccgaagtcggccacgtgcgtcagggcttcggcctcgttttcaaaggccaggtgcttggcggttggaaccccgtacttgttcataaaggagagggcgtattccttagaaccttccagctgggccgcccgggcgttagggccaaagatctttagccccgccgtttgaaattcgtcgacgatcccagccaccagggcgtcttccgggccaacgaaggtccaggctacctggtgctcctgggcaaacttaatcaacccagcaaagtccagttcttcgatcgccaccggttcaaccccaaccgttgtcatcccaacgttgcccggtgcgcagtagacgtggtcgaccttggggctttgctttagtttcttagcgatcgcaaactcgcggcccccgttaccgatcaccaacacgttttgtaatgtcatgattttcctcctgattttccatgaacaggcacaggggttggaaaaagcttcccttctcccaacccctgtttaattttaaattgaccatgtacgcacgaccaaaggatgccaggccttagcccacggcctgccaaaggctggatcgcacttctttttaacgtgctccccaaccgcagacctagtggctaagtacggacggagaacagtgcgtaccgcactaaccccctccctagcttagcccacggcctgccaaaggctggatcgcacttctttttagtgcctaaagtggcgcaccccggtcgtcaccatggcgatcccgagcttgttggccatgtcaatcgagtcttggtcgcgtaccgagccccctggttgaacgatcgccttgacgccgtgttcgccggcgtacttaacgcagtcgtcaaacgggaagaaggcatcggaggccaagacgctgccttcgaccaagtcgccggcgtgcttgacggcgatcttcagggagtcaatccggtttggttgaccttcccccacgcctagcgtccgttcattgttggccaccacgattgcgttggacttagcgtgcttaacggccttccaagcaaacatcattgccttcaattggtcttcggttggcttaacgtcggtcaccacttcccagtcgtggcagtcctctttaagcgtgtcttggtcttgcatcaagagtccccccatcacggaaaccacttcttccttggttggttcgtccttttggtcaaagtcgacttgcaagaggcggatgttcttcttcttggccaagaccgcaaaggcatcgtcatcaaagcccggcgccacgatgatttccaagaagatcttccgcatcttttcagcggtcgccaggtcgaccttgcggttcagggcgatcacgccaccgaagatcgaaacggaatcagcctcgtaggcccggtcccaagcgacttccaggctgtcgccgcggccaatcccacacgggttcatgtgcttcatggccaccacggttggttcgtcgaattcacgcacgcaccgcagggcttcgtcggcgtccttgatgttgttgtaggacagcttcttgccgtggagttgttcggcctccaaaatcgagaagctcttcggcagggcgtcttcgtagagccaagcgcgttggtgggagttttccccgtagcgcatcgtttcctttaggtcgtaagtcagggtcagcttttccgggtcttccaggcccacttgagcggtcaggtactgggagatcaaagcgtcataagcggcggtggtccggaaggccttggcccctaacttgcccttggtttcggaggtcgtatcgccgttttcttcgatttcggtcaggacctggtcataatcgttgatgtcggtaacgatcgtgacgctttggtagttcttagcggccgaacggaccatcgacgggccaccaatatcaatgttttcgatcgcatcggccagttcaacgcccgactttaagatcgtttccttgaaggggtagaggttgacgcacaccaggtcaatcggggtgatcgacaggtcttctaaggtcttcatgtgctccggcaagtcgcgccgggctaacaggcccccgtgaacgtaagggttgagggttttcacccgcccgtccaagatttccgggaagtgggtgacgtcttcaatcgagatcgtcttaatgccggcctcatccagggccttcttagtccccccggtggagacgatttcgtagccgtgctcttccagcccctttacaaagggcaccaagttggttttgtccgatacagaaactaatgcgcgcttcatgctattctcctttttcaattcgcttggttaagacttcttttaggaccgctgggtagaggcggtgttccgtttcgtgaacccgttcttctaagctctcgatcgtatcatcgggcttgattaccacgtgctcttgggcgatgattgggcccgagtccagcccggagtcgatgtagtggatggtgaccccggtttgtgtttggtgatcggcaaaggcccgttcgattgaatgcaaccccgggtaggccggcaagtaggccgggtggaggttgacgatcgaacccccaaagtgatccaaaatcgtcgggccgaccacccgcatgtagccggccagggcgacaaagtcgatttggtagtcttgtaagaccttcaaaattctcttctcatacgcaggcttgccaccgcattccttaacggtgaaggtttcataagggaccttcaggcgcttggcccggtcaattacgtgggccgtggggtggtcgcaaaataacagcactaagtcgcctggtaagtcgtggttttgaaattgctgggccaagatttcaaagttggtcccgtttcctgacgcaaaaatcgctactctcatgctcttcctcacttaatcacaatcttctcttcgccggccggccggttaaccagttgtcccacttggtagcacgcctcgcccgcttggttcagccgactcttaacttggtccactaggtccggttgcaccgctaggatcatccctaaccccatgttaaaggtttgccagcaatcgtcatcactcaacccacccagttccttgaggtagtcaaaaacgggtaggcttggccaggcgctgctgtcaacttgggcctggaggccgtcgccaaacatccgcggtaggttttcgatcaacccgcccccggtgatgtgggcgaccccttcgaccaggtggtcctttaacagcggcaagaccggtttgacgtagatcttagtcggcgccaagacggcttggccgaccgtttgcccgcccaatttggccggcgttgcggctaggtcaacctggtggtccttaaagaggatttggcgaaccagcgaaaaaccgttggagtgaatcccgctggaagccaatcccaacaaaatggcgcccgcctgtggttggtcgctagtcaagaggtcgtctttttcgaccaccccggtgaccgtgccggccaggtcgtattcatcctggtcgtacatgtccggcatctcggcggtttcgcccccaatcaaagcggcgccggcctggcggcacccttccgccacccccgccacgatgtcggccatcttggcggggtcgttgtggccggtagcgatgtaatcgaggaagtagagcggttcggcgccctgggctaagacgtcgttaacgcacattgccaccacgtcgatcccgatcgtgtcgtgttgatccatggccttggcgatcaaaagcttcgtgccgaccccgtcggtgccagacaccagcaccgggtgcttaaccttcagttcgcccaagtcaaagagtccgccaaaggccccgatgccgccgagcgcccccggccggttagtcgatttgacgttttccttgatccgtttgaccagttcgtaacccgcgttaacgtcgacgccggcttcttggtatcgattcattagaccgtgacttcctttctggccagtttctcttgttcgctcagtgacttgcggtagccctcctcgtaatcgtagagcggcgttgggtaattaccggtaaagtaggcgaccgtcaggccaccattgggcgccccgttgacgttgggcaggttgatggcttcgatcaggctgccaaccgacaagaagccgaggctgtcgacgccaatcaaatcccgcatctcttcgaccgtgtggtgggcggccattagttcggcccgcgtcgacacgtcgataccgtaaaagcacgggaaccgaaacggcggggaggcgatcagcaggtggacctccttggccccggcccgccgtaacatttggacgatctgcttggaagtcgtcccccgcacgatcgagtcgtcgaccacgatcacccgcttgccttccacgaccccgcggacggccgacaacttcatttgcaccgcccgttcacgcagttcctgggtcggttggatgaaggtccgggcaacgtattggctcttgatcagacccatttcgtacgggagccccgcctcttcggcgtaacccgaggccgccgacagtgaggagttcggcaccccaattaccatgtcggcgtcaaccgggtgttcgcgggcgagcaggcggcccatttgcttacgggcgttgtggaccgttaccccgtggatgatcgagtccggccgggcaaagtagatgaattccatcgagcaaattgccagctgggtgttggtggtgtagtgatcgacgtggagcccgtctcggtcaatgatgatcaactcgccgggttcgacgtcgcggacgaacttggccccgacgatgtctaaggcgcaggtttcactggtgacgacgtaggcgccgttctccagttggccgatgcacagcggccggaaaccgttcgggtccaaagcggcgatcaagcggtccttttgcaaaagcaggtaggcaaagccccccttgacttcgtttaagctctgcttgagggcgttaatgaagccggactggatgtgcttgcgaatcaggtggatcaggatttcggtatcggaatcggattgaaagaccgccccttcatcctctaattggcgccggagggtgacggcgttggtcaggttcccgttgtgggccagggcgatgtcgccatcgtggaagcggtagaggaacggttgcacgttttgaatcgagttgtgccccgaagtcccgtaacggacgtggccaatcgccccgtcaccgactaggcgttccagttcggccgggtcggcaaagacctcggataaaaggccacgatcccggtgttggtaaagggtttggtagtcggtggagacgattccggccccctcttggccccggtgttgtaaggtgtgcaggcccatgtaggtcaggctggcggcgtgttcggcgccaaagaccccaaagaccccacactcttcatttaatcccttgatttcagctggcacggaatggcctccttccacaattgttctaagtcggcaacgtttttgttcaggttgccgtccgccaggcgtacctggagccagtggctgttggtaacttccccaatcagcgtggcgtcgtcgcccaggcccgcctcaaaggccgcagcgtcttcttttttgacggtcaccacaaagcgtccagcggtttcactaaagagttggttcttggttaagtcgagcttgaggttcatccccaggtcggtcttgaagagcgtttcggctagggcgacccccaggcccccttcggccaggtcgtgcgcggacgctaccttgccgtcttccattagggacagcagggtttgcatcatggcgtggacgtggtttaagtcgaagtcggccaccgtcccggcgatgtcgccggtcagcatcttttgcagttcgctaccggcgtagtcgtcaccggtttggcccagcaggtagacttggtcgccggctgcttgggccgccatcttaacaaggttctttaagtccttgatcaggccgaccatcccgaccattggggtggggtgaatggcctggccgttattttcgttgtacaaggaaacgttcccggaaatgaccggggtgtcaaagacccggcaggcttcggccatcccggacactgattggtggagctcccagaagatttctgggtcgttggggtccccgtagttcaagcagtcggtgatcgccagtggcagggccccagtggcgacgatgttagccgccgcttcggccagggccatcttgcccccaacttccgggttgaggtacacgaagcggccgttgccgtcggtcgtcatcgccaggcccttcttggtgccgcggacccgcaggaccccggcgtcagacccggggccgaccaccgtcgaggtccgaaccatcgagtcgtattgttcaaagaagattgacttgtcggcgatcgtcgactgttggagcagttgttccagggtcgccccggcgtctgttacttccggttgccagttagcctcttgttcggcctgcaaaatccgggccggcttttgttcttcggaggtttcttctaagacgtcgtcggttaagctggaaaccgggatgtcacaaacgacttgcccgtcgtggtgcaagacgtactggtgcccctccgtgatccggccgatcgtgacggcttccaggccgtagaagtcaaagatctttttgacgtcgtcttcgtggcccttgttgacgcacagcagcatccgttcttgggactcggacagcatgatttcgtaggccgacatgttcggttcgcgttgcggaacgaggtcgaggtcgaggtccatccccgcatccccttcgctcgccatttcggcggacgaggacacgatcccggccgcccccatgtcctggatccccactaaccagtcggggtggttttgaatcaattccaagcaggcttccaagagcagcttttccatgaaggggtccccgacttgcacggcggaccgctgggtggcgttttcgtcggagaagtcggccgaggcaaaggttgccccgtggatcccgtcacgaccagtcttggccccgacgtacatcacggcgttgccgatcccggcggccttccccttttggatgtccttttggtccatcaagccgacgctcatggcgttgactaagaggttgcccgagtagcacgggtcaaaggtcgtttccccggccacggttgggatccccatgcagttaccgtaatccccaatccccttaacggtaccagcgaccttcatttgcatcttcgggtcgtcgagttcgccgaagtgcagggaatcgaggctggcgattggccgtgcccccatcgagaagatatcacgcaagatccccccgaccccggttgcggccccctggtaaggttcgaccgtcgacgggtggttgtggctttcggccttgaagaccaccgcttggccgtcatcgatgtcaacgaccccggccccttcaccaggcccctggaggacccggtcgttttggttggggaacaagcgcaagaccggcttggacttcttgtaggaacagtgttcactccacatggcggagaagagcccggtttcggtgaagttaggcaaccggcccaggagtttttctgaaatgtagtcgtattcgcgctcgcttaggctccagtccaagtaaggcttttgttccttaatttgttctggcgttaatgcttgcttcatttcctatccctccgcaatgaccgtgccgttttccaacagtgacttaaagacccgcaggccatcggtgttgcccaagattgcttcgaccgcccgttccgggtgcggcatcatccccaagacgttgccggcccggttgcagatcccggcgatgttgtttaaggagccgttggggttttcctcggcgtaacgaaagaccacctggtggttagcttccagctcgtccaaggtggcttggtcggcaaagtaggaaccatcggcgtgggcgatcggcaggttaatccgttcgtgttcttggtactggctggtgaagatcgtttggttattgacgacttctagtggcgtcgtcttgcagacgaagttttggctgtcgtttttctttagcgcccccggtaacaggccggcctcggttaaaatctgaaaaccgttgcaagtcccaaagaccggcttgccttcgtcggccaggcgcttaacttccggcatgatcttagcgaagcgggcaatcgccccggcccgcaggtagtcaccgtacgaaaagccccccggcagcatcacggcgtcgtagccggccaggctggtttgctggtggtcgacgtagtccacgtcggcgccgtaaaccgtcttcaacgcttcgtagaggtcgatgtcacagttcgaccccggaaagacaatcaccgcaatcttcatttacttctcctccagtacttggtaggtgtaggtttccatgttgaagttaaccaagagttcctcggcaatttgcttaaccgtcgcttcaacttggtcgccgtcaaccgttacgtcaaagaacttgccgacggtgacgctcttcacgtcttggtggccgagggcgtgaatcgagttggtgatcgtttccccctgggggtcaaaaacggatggcttgtaggtcacgtaaatccgaacggtggtcataattagtcctcctttagggctgcttgtaaacgggcgtacacttcttggtaggtggtcgtcaggtcggcgaggttgcgccggaagacgtctttatccaggtggtggtgggtagtcgtgtcccacaggcggcagttatccggggagaattcgtcggccaagataatctggttatcccggctccggcggccaaattcgagcttgaagtccaccagttgcatgccggccttttcaaagagcggcgttagcagttggttaacctggcggcaaatcgcccagcaccggtcaaattctgccggggtcaccatctttaaggcgacggcggccgattcgttaatgaaggggtcgtctaattcgtcgtccttgtagaagttttcttcgaccggttgcggcagggccgttccttcctccaggccaaagcgggaagcgaagtggccggcgacggtgttacgggtcacaaactccagcggtaccatggcgcacttttcaactaggtcctcggtcgccgacagcttcttgatgaagtgggtttcaattccgtggtcaatcaagtagtggaagaccaggtcggaaatggcgtgggccgcggcccccttgccagcaaagtgttccttttgtttcccgttcaactgggtggcttgatctaagtacaccacccgcagttggtcctcatcttcggtggtccacatttcctttgccttcccggcgtacaacagcttctcttccattttcgcggtgactccctttcagtaaaacacgaacaataattattattttcggcgataaattcgctaaatcgtgaccatagaataacaagttttatcatcactcgtcaacaaatcgacgccattttaatggaattatcactttaatgttcgtgtttaatcgcaaggatggggtaaaacggtttaagataacggtttctagttcgttaatcatctatttaacggtttttaaaaagaggctgggagaaaacacgattttctcccagcctcttgttgtattcacgaatgttagacagataacgtgctccccaaccacggggctagtgtctaagcaggacgaagaacgatgcgtaccgcatcaaccgctcgtcccagcttatccatacaccccgtcgaggaggttgggtcgcacttccaaatataacgtgctcccaaccgcaggcctagtggctaagtctggccacagaacaccgctgacgcgctaacctgtaccctatccttaccccacggcctgctttatggttggtccgcacttccttattccgtcttctcactcaccttcttggcgtcccccagtgaaacgaccttgtagtcgctgccgtctttgacgatggtcccgttgtagcggaagacctgggtcttggtgctgccgtcttcaaagtcgaaggtgtaagtgacgtcgtagttaacggtggtttggttatcgccggccggggcgaccgagttaacccgggcctcgtaatcgtagctatcaatcgaatcgttgccgctgtgaccattggccatcttgattaactgctggtagtactcgttgctggcaccgtccttgaagtaatcggccagggtactatcatcggtgctgtcacggacggtcagggcctctgagtagacgtccttcatcagggtgtcggcgtcatccttagaaatcatcccggtgaaggtcggggcgatctggttgtcgtaatcgaggtccttgccaatcgtggcgtgcttggactcgtaggtcttgccactggcgttgacggtcaagtaaacgctggtgttgccgctcactgggtagtctttgagttccaggctaccactgtcgccaatcgtgccggccttatcgccgccaacgtaaaccgtcgccccgctcggtccgaccacggtgaaggtcaaagtcgacagcccgacgtcgacggtggtcgtgctccccggcgtcagggtggcgttggccttagccgtgatcttgcgaccgctcaccgtcccgctggccgtaaaggagtagtcccccggcacgtatggcccaaccttgtgggtgtaggcggtctgggcgtcgttgctaaagctggagtaataagaacggctggactgatcgttggcgctaagcgtggcaacctgcttaccacccatcttcaccgtgactccctcgtggttagtcattaactcggcgtaggccggttcaaaggaaatttggtagcgcgggaagatcagccagtgactgcccgaacgcacgtagcggtaattgccgtaggtgtcgctagtcaagaaggtttgcttcagggagctgagttcgctggcgtgaccggtaaagtagcgttgcaacggctttgcgttgtccttggtgaccttcaggctggtgttggcgctgaccaggtagggtgaggcgtcctctttggttgacgaaagggcgctgatcgcccggttgagctggttttgccgggagtagtagctactcccgacggcgtaacccccgatcaagacgaccgccgccaccccaacgccgatccacagcggcttgcgggacttaccctgggggcgctgccggcgctgagcccgggctggcgttggtgcctcatccgctgcttgcttagccgccggggcggttgattgcggcgccgcacttggttggctggaccgcgtggaagctacggggttggccgaagcaacttcagttgggcgctgctcagggaccttagactccggtgcttgactagctgagcccggtgccggttccgtggccgtccgcagctggtagccacagttcggacaaaaacgggcaccgggctttaattcgtgcccacaattggggcaaaactttgatgccatgatccagcctcctaaaatagactatacataaagtcgccgaacgatttcaaagcggaggccaccagttcttgccccaccaagaaggagaacagcatgtaaatcaggccaattgccaccgctaaaattagaccggcgtacaccggatcgaggctgccggccccgtgatcgctacgcaagaccgcccggtacagcgagaccgtcagcaaactcaagtccaagctgaacaagatcaccatgaagataaccaccgtggtgtaggcaaacaggagcgcgatcactaacagggccaggttaaagaagacgatcaggtttgtttcgtgcaccacctggttggtaaagacccaaaaatcgttttccggctcccgttggctgacccgttgcaagaggtaggcgcaggcgatcatcaacagtgcggcgacgatcgcaaacagccagccccggaacaaaaggccagttgcggacggcgtggtcgaggctgctccagtgcccgtgtgcccgttgattatggcaagggtgtcaaaccaggaacccccaaacgccgaggtggccgcgtgaagcgcccgcgttagaacggcgaggatcgctaacattgccaacaacgtttcgccgacaatcgttaagaccccggtgtacttaaacttcggttgcaccaccttggttggcgccttcaccgacccccacagccagctccagtagcccaccgccccggccttgagccggtcggtatcgacatttttaacggcggtactagcggcgttcatcgcgctcgccgccacccccggttcctttttctccgcggtcagcggttgaccacagttagtacagaacttggtcccctcctcgtagggttcgccacagattgggcagacgttcggcgtcgcttgtggcgcctcttctttcgtcgttggggcggttgattgcggcgccgctgccggtttggcttcggccaccgctagctgagcgccgcagttggtacaggacttagtgtcggcaggcatttgggccccgcagtttggacatgtttgcatgatctctaccccttgattaatcattcaatgtaactttaaacgttacatttattatacgatcagccgcggggtggaacaatcatttcgcttaagaaaaatttattttttaaaaggagtgcgactagccttctcgacgagccgtataactaagctagggcaaatggttggtgcgccagcaccgttctttgcccgtacttaggcactaggctcgtggctaggagcacgttatcagtgctgccgttgcgacccagccatttggcaggccgtgggctaagctagggagcgggtaggtacggcaatcaaaaagcccccgccgcctaacgtagacaacgggggctcaatgggttggtcgcacccactaattagtccaaccctacccggtggaagatgtcatcgacgtggcgcaggtgccaatggtagtcgaaggcgtcatcgaggtcttctttggtcagttgcttagccacgattgggtcggcttccaagagcgggcggtacggaacgtggtcggcccagcacttggcggtgtacttttggatcaggtcgtaggcgtcctcacgggtcatcccggagttaaccagcttgagcagtacccgtccggagtaaatcaggcccagggtttcgtccatgttatgcttcatccggtccgggaagacgtccaggttcttgatgatcttgccgaagcggtggagcatgtagtccaacagcgccgtggagtccggcagaatcatccgttcggcactggagtgggagatgtcgcgttcgtgccagagggtcacgtcttcgtaggcggtcaccacgttgccccgcaggacccgggcacagccgcagatgttttcggagccaattgggttccgcttgtgcggcatggctgacgagcccttttggcccttagcaaagtgttcttcgacttcgtggatttcggtccgttgtagggaacgaacttcggtggccatgttttccagggccgtaccgactaaggcgatcgccgctacgtattcggcgtgcaggtcgcggggcaggacctgggtggagatttcttggggacgcaggccgagcttttggcaaacgtaggcttccacttgcgggtcgacttcggcaaaggtcccaaccgccccggagatcttaccggcttcgacacccttagcggcgtgctcgaagcgttcctggttccgtttcatttccgagtaccagcgggccagcttcaaaccaaaggtagttggttcggcgtggatcccgtgggtgcggcccatgcagacggtgtacttaaattcgcgggcccggtcggccaggatgtccatgaagtcctggatgtcttggcgcaggatgtcgttaaccttctttaactgcaggccctgggcggtgtcgacgacgtccgtggaggtcagcccgtagtggacccacttgcgttccggccccaaggacttggaaacatcgcgggtaaaggcaatcacatcgtggtgggtgacggcttcaatttcgttgatcccttcaacggtgaaggtggcgttttggcgaatcttttcgacgtcttcggccggaatgtagcccagcttgctccaggcttcgtcggcggcaatttcaacgtctaaccagcattggtagcgagccttgtcgctccagatttccttcatttccgggcgggtgtaacgatcaatcatcagttagttcctctctttttaagcgtcccaaacgtgggtggcagcaatttcttctagggtggcgtctaagtcgttggttaggatggtcacgtggcccatcttacggttaacccggctgtcggccttgccgtaatcgtggaagtgccaggtgggcttgtggctgattaaagcggcaacgcccttctggtgttggcccaagacgttcaccatgacggcgggctttaataacgttggctgtggtagcggccagttgcagatcgcccggttgtggatggcgaactgggagaagtcgcaggcctcaagcgaaaagtgacccgaattgtgcgggcgcggggccagttcgttaatgtaaatgtggccgtcgtgggcgacaaacatctccacccctaggatccccttgaggtccagttgctcggcgatttgcttagccatctcccgggcccgttcctgcagggcggtgctgatccgggccggcacgatcgacaggtgcaggatctcgttttggtggatgttttcgctgaccgggaaggtaacgatctcttggttggcgtttctggccaccatcaccgaacactcgaggtcaaatttaacccagccctctaagatgcagttccccgtcgccaagacatccgtgcacttcgccaggtccgcggcgcttttcaggatgacttgaccgtggccatcgtagcccccttcgcaggtcttcaagacgctcgggtagccaatcttggtgacggccgcctctaattcggcctggttagtgaccgccgcaaagggcgccgttgagaggcccgcttcttgtaagaaggtcttttcccggatccggtccttggtgatccgcaagagttcggtcccctgcgggatggcgacttggtcggcgaccgcttctagggccgccaagtcaacgttttcaaactcgtaggtcaacacgtcggcgcgcttagccagctcttcaatcgcttgcttgtcctcgtagggcgccacaatctggtcgtcggcgcattggccggccgggcagttgggcgtcgggtccaggataatcaccttcatgccggcgtacttagcgtccaatgccatcatctggcccagttggcccccgccgatgatgccgattgtccccccctggggaatgtagcccgccctagtcaaggtcggcactgctttccacggactggtcgtgcatttgctgacggtaagcgacgatctgtgcttggatcgccgggtcggccgtccccaggatctcaagggcgagcagggcggcattcttagccccggccaccccgatcgccgtcgtggccaccggaattccggccggcatctgcacgatcgaaagcagggagtccatcccgcccagggccttggtctgccccggcaccccgatcacgggtagcggggtgttggcggccaccatccccggcaggtgggcggcccccccggcgcaggcgatgattaccctggtccccttgccggcggcttgcttggcaaagtcgaacatttcttggggcatccggtgggcggaaatgacctgcttgtcgtaggccaccccgaactgatcgaggatggcgcacccttccttgacggttggccaatcggaggtgctccccattacaacggaaatcttactcatgcttgttcccccttctcaaactgtctttagaataccaaaccgcccgggcgaaaacaagcaaattcacgaaccagattagattaactttttataattgttcggattttagagaagtgcggaccaacctcctcgacaggccgtgggctaagctagggggaaggttgatgcggcacgcatcgttcttcgcccgtacttagccactaggcctgtggttggggagcacgttatctgtgtaaccggaaaccaaaaaaggctgggggaaccattcccccaaccccattgtttactaaaataaccccgttatcttcccctcggcatcaatcgtcatcttaacggcggccggcacctttggcagccccggcatcgtcagcatgttaccagctaaagcgacgataaagccggcccccaacttcggtacgaactcgcggatgtggaaggtaaagccctccggtgcccccagttgggtttggtcgtcggtaaaggagtactgggtcttggcgatgcaaatcggtaggtcgttccagcccagcttttcaaactgcttgagctggtttaaggccttcttggaaaaggcaacccgtccggcgccgtagaccttggtggcgatcgtttcaaccttttcctttggcgtggcttggtagtcgtacagcggagtgaagctggcttcttgctcggccagggccaccacttccttggctaagtcgagcgtccccgcgccacccttggcccaggcgtcggcgaccaccacgttgaccccgcgggccttgcagttgtcttcgatcagtttgatctcggccggcgtatcggtggcaaagtggttgatggccacgaccaacggcaggccgtagcgttgcatgttggcgatgtggcggttaaggttttgcaggccgttttctaattcggtcaggttctcgtcctttaatgcttgaaggctggcgcccccattgtattcgagggcgcggacggtcgctacgatgaccacggcgtccggggtcttgcccaggaccggccgcttgatgtccaagaacttttcggcccccaggtcggcaccgaagccggcttcggtgaccgtgtagtcggctaattgcagcgccgttttggtggccaagaccgagttacaaccgtgggcgatgttagcaaacggccccccgtgaacgatcgccggggtgtggcccagggtttggaccaggttgggcttgatggcgtcctttaagaggatcgtcaccgcctcttcaaagccgagttggcccaccgtgaccggttccttatcgtaggtgtagccgaccacgatccggctaacccgggcctttaagtcgctcaggtcggtggccaggcacaaaatcgccatcaattcggaggccggagtgatgtcaaagccggtttgtcgcggcaccccctgcatgatcccgcccaggccggtcaccacgtcacgcagggcgcggtcgttaacgtcttcgacccgcttccagatcacccgccgcgggtccaaaccgagttcgttgccccgcatcaggtagttgtcgatcaaagcggccagggtgttgttggcgctggttagggcgtggaagtccccggtgaagtggaggttaatgtcttccatcggcacgacttgggagtaaccgcccccggtggcgccccccttcatgccaaagactggccccatcgaaggttcgcgcatggcgatgacggtttgatggtgcaataaggacagggcgtcccccaagcccaccaggacggtcgacttcccttccccagccggggtcgggttaattgacgtcaccaagaccagcttgtgcttcttttccggcgtcgcttgcaccggtaagttaaccttggccttgtacttgccgtattgctcgatggcatcttcatcgagccccagctgggcggcaatttcgttaatcggggtgagttgggcttgatcagcaatttcaatatcagttaacacggtgggtcctcccgttaaatccgaacattatataacaatctaatttacaagattaacaataatcgaactaactcccggttgcaagtcttatttgtcccggttcgtcggtaacttatggacccgaatctgcttaacccccacgatgtccaaaaggaaggtgaagatcggcaccccgacaatcaacccccagacgccaaagaggtgttcggacaccaagaggaccacgaaggtgtaaaagatcggcagctcggtccggctggacatgaacttggggtttaaaacgtaggattcaatcatgtggatgaccaagattacgatgattaagtaaacgatgtaacggatcccgccgaccgaatacccgaccatcgagagcggaaccaaggaaatgatgaccccggccaccggcaccaaggaaaagatgaagaccatgaggccgagggcaaagatctggggcatcttcatgaagaacagggcgatcatggtcaaagcggtgttggttaaggcgataaagaactgggcctctaaaacgaccccaaaggtgttgacgaacttcttaccgaagaaatcgaggtccttgaaaaaccagctcaggtgttggctggacaagaaggtcttagaaaactcgttcatctggcgaagctcaatcgtgtaaaagaagctcaaaattaccgacatcgccaccgctaccagtaaggtcccaaagttggtcaaggtggtcacggctagggtaaccccgtggcgggcttgggtggccaacgtcgagctcgacacaaactggttgaggtacttcatcagccagtgcatgtcggcactttggtagaaggtaatcagcgaattggtcatcttaaccagctggttgaccaacatcggcacgtaatcggtgaccacgtaaaagaggcctaggatcaaaagcaagtagctcaacaagaccaccagggtgactggcacccgggggatccaacgttggaccaagcggacccagtggacgattaagtaggtgaaaataaaggtcaacaagatcgtgttcatcagcgagcgagcctcgtataagaccaacacgatcaccaagaggaccaccaagcggcggagctcctgttttttagtaaatttgttccaaaagtctgtcatggcaaaaatcccttcccagttgataaccctatcttagcaaagaacccgccataacgtgaactactcggccataaatgaccgagcttctgggaacaaaaatttgttcacgcccccctccatcagggcgatggccacctggatcacctctgctaggggcgcttgtttgccgcttagcacccactggcggtagacggctaggccggtgttttgaacgaaggttaagagggcctgttttttaaaatcgctcagccggttgaaggccgggctgttagaccagtttttgcccatcaccgtgtcgatcatctgttggcggatggccgagtagtgggtgttaatggttatcttttcgtaggccggcccctacttggccgaaaagttaaaaaagtaggtaatgctcttggccaggtcgcgcgggtagaccaggtccttagttagggccaggtaatcttgtgagaggctcgtttgcaattcggccagcaggtcgtctttagttgggtagtagcgataaaaggtctttttattgatttgggcgcggcgggccagttcggccaccgtgatcttttcgtaatcggtggtcaaaatcagctcctcaatggcctgataaatcgcggtgatcgttttttggacccgcaggtcctcggttccgtttaagttcatgttcccctccgtttaattgacggtgtgcaccccgacttaaacgatccatgcaagggtgagcacttttaacaatgacttgacacccggggtgtataattaacaaatataattgtgaaagaaggatgatggacagatgttagaaaagacgttctataaaacgttactgagccgctcttttaagaacgtcccggtgaaggtggttttttgggatcactccacggcaacctacggggatggggatccggaaattacaattacctttaacgagaagatcccggtcactgacgtaacgcgcaacgcctcactagccctgggggaagcctttatggataaaaagatcgagctctcgggtccggccaacgtgatcgagatcctgatcaacgcggcctaccaaagcgccgaaagcttcatgcacgactccaagctgcgccgcttcatgcctaagcaaaaccacagcaagaagagttccatgtccgacgtacaaagccactacgacgtcggcaacgacttctacgccctgtggctagacaagacgatgacttactcctgtgcctactttgaagagggcaaccaagacgacttggaacaagctcaaatcgccaaggttcaccacattttgaaaaaactgcacccgcaaccgggcaagaccctcttggacattggctgtggctgggggaccttgatgctgacggcggcccgcgagtacggtctcaaggtcaccggggtcaccctgtccgaagagcaatttaagctggtgcaaaagaagatcgatgacgagggcttaagcgacgtggcggaagtccacttgaccgactaccgtgaattaggcgatcgccagtgggattacatcacctcggtggggatgtttgaacacgtcggtgccgaaaacctcggtctctacttcaaggacgtggccaactacctggttgacgacggggtcgccctgattcacgggattacccgccaacaagggggcgcctttaacgcctgggtcaacaagtacatcttcccgggtggctacattccgggcttgaccgaaatcatcggccacatcgaagacgccggcttgcaaatcgacgacgtggaaatgctgcgccgccactaccaacggaccctggagctttggaaccaaaacttccaggcccaaaccgctaaggtcaccgaaatgatgggcgaacgcttcgtgcggatgtgggaactttacctgcaggcctgcgcggcgtcctttgagtccggcaacatcgacgtcatccagtacctgatcaccaagggagcgtcgggtaagaacttgccgatgacacgggattacatgatcaaataaaagaagtgcggacccaaccattggcaggccgtggtaaggtttggctacaggttagcgcgccagcggtgttctgtggccagacttagccactaggcctgcggttggggagcacgttatttggaagtgcgaccgggagaaaaatttctctcggtctttttttgattattacacagataatgcgctcctaaccacgggtctagcttagtccaacggtctacttgacaggttgggtcacactttcctttttaacacaggacaaatatttagatttgtgcaaaacagaagcgcggaccaactatctagccactagatttgcgcaaatttgcagatttgtcctgtcccctagcccatcacccggcccacttcttttaaaactaacgggaattgttcgtaaccgtcgctggttaagaagtggccgccgcggtcttggacgatcaacttagcgcctagccccttggccaccgctacccccagctggtagggggccacgtagtcatccttagccacaatcactgtcgcccggtgaagttgcggttgcaaggcctttaaatccagttcgccggccatgtaagcatcgaggctcgggtaagtcggcagcgggtcaacgaaggcgcccaccaagaccaggttggcacccttgatttccgggtggcgggctaaatagcgcagcgccgttacgcacccgaggctgtgggccactagggtcagtccgtctgctggtttgatttgatcctccagggcgctgtcccaggccgcctgcatcggcgcaaacgggtcgggaagccaaagccgctcgagtttaacggccggggccagggcctcctctagccagggaaaccagtcgtcatcgcgcgttgaggtgccgtgaattaagtaagcagtggtcatcaataaagccccctaaaagaaatgcctgaagcgccacaagacgtccgctagcaccgacttggacaagcgatcaacgacttgatcgttggagcggtcggccaaagaaattgcccgcgggtgctgtaataacattaaccacaagaaaagggaccgagagaaaaaagcttctctcagtcccttactttgatttcgttcttttataaaaacaggcccagcgcccagacacccaccaggccgaccaggacggaggccgccatcgagcgggtgaagtaggcggtgatcgccacgagaatggccgccacgatttgactggcgtggccgtaaatggctaggttgcccagcaacttaacgtggtcttgcaccaagctgtaatccgaggtgatgaagatccccttgatgaccagggcggtgaagaggctgatcggcacgtacttcatccattcgttaaaccactccggaatcttacggttggtgaagaaccgcatcgggaagtaccgcggcacaaaggcggcgatcgccgaaatcacgatcacgatcaggtggtaagttaggttgtggtggctcggaatcaacgactgtgcttccgccaggttaattgaattcatccatcccatcattattcaccatcatccttttaaatctagctgggcgtcggtcttggtaaccttggccttcgcctcttcttgttttttgatgtgctggcggtcttccaccgtgttatgggttgcggacggcctaaacagcttacccaaaatccaggtgtgatccggatccttggagtaatggcgcacccggttttcaatgataaagccgacaaaggaagccaaaacggtggccaagataatccccaaggtcgacttaaccagggtcaagaagtagattgacagcccggcggacaggatcccgacgaaaagggtcaggcgctggcgcacttgcatcacgatcatgtagataaagagggccgtcaaggcgaagtccacgatcactaagtcgatttgcacggcggacccgatcagacccccgagcaggttcccggtggcccaagaagccagggagtagtactcaactaagagggcgtctttggccgaccagtccttgtcggtcacaaacttcatgtagttgatggcgtagttttcgtcgttcattgaggccgaaaaaatcaggaccgacttctggctttcactgcacatgtagcgagaaaggctcgaccccaagagggcgtaacgcaattccaagaagaagagggtcataaaaatcgaggtgatcggcgcatcactgaccaacagggacgccagggtaaactgggcccccccggagaagaccatgatcgaaaccaagaaggttacgacgaagttcatccccgcagcgttcaaaaggatcccacacgcaatcccgatcggcaggtaggacagacaaaggggcatggaaacccccaggacctccaaccagcgggcgcgttccgggttgatttgatgtgcttttgccaaagcaattcctccacaaataatgagttgtctatttcgctttctttcggacgggtttttgacccggctaaagaatagtttaccatatctaaccggacgtgagcagccatctcttttcttcggtggtaatttcccgggaaatatcggaagtgcgactaaccttctcgacgagccgtatggctaagctagggcaaatggttagttcgcacttcttttctttagatatggctctttacccagcggcccatgcgtacgaagacgttggccttgtcaacgttggtggttggtactacgtcgacggtcagcttattgccgtccaaaccggtcaaaccggcgtaagtcagctcaccgaccacctggccctttttaaccggggcggtcagcttaccgttcttgtcggcagccttgctgttgatggctaggctcggcgacagcagggtgccgtccttcttccagagggtaatcttaccctgagtggtcaaggtcgtggtggtgaccttcccgttcggtacggtggcggccacgcttggttgaaccgtgtaggccgtgtattcgttggcgattaagcggtagaggttggcggtttgggtgaaccgttcatcacccccaccagtagcgtggaggaccacggtgatgatccggtgcccctggtaggtcccggtggaaacaaagcaggcgcccgccttgtccgaagtcccggtctttaagccgtcaatcttgacctgactcggggcgtcgctttgcccggggagcatcttattgatggtggtcacggtggtgccatcaatcgtggtcgaagtcagcttggtgatgtttaacaagctcgggtagttcttgattaagtactgggcgagcttggccacgtcggtcgccgtcatttcgttttcggcgtttttcgcaacccccttgaggccgtagctccccatttggctgttggtcaacccgacttggttgtacaacttggcgtcagtgaccccggcctttttgacgaaggcttgcatcttcttgacgaagctcgccgtggaatcgccagtcacccgcgacagggtgatggcggcggcatcggccgacttgatcatcgccgcttcggtcagctccttgaccgtgtaactcttacccgccgttagggtgatattggagtactcggtgttttccgataacttggcctcttctttagtgaccttgaccttggtgttccaagatagctttcccgccttgatttcttgttcaatcacccctaccgtaatgatcttagagatcgaagcgatcgccagcttggtgttggcatttttggcgtagaggacctggccggtcgtggcgtcaatggcgattgccgccttggcgttgaccgtgtagtcggtcgtcgaattcgtggatgagctggaactagtcgaactggtcgtggtatcagcgtggaccgccgctggaaccgccgtcaggctgccggccgtcatggttaaactggccaagaagaccccggtgcggtacaaccatcgtttaacttgcttattcattacctaacttctttctgtacttgtttaactggcaacgttaccacaaaggccgtttcctgatcgtcggagcgggcggttaccgagccgtggtggagttccacgattgattgaacgatcgccagtcccaacccggttcccccggtggccttgttacgcgacgactcgacccggtagaagcgctcaaagaggtgcttaactgattcggcggggatcttctccccgtcattggcgaccgtgatgaccaccttttcgcccagttgcttggccgtcaggtggatgtagctggcgccgtgaccgtatttcagggcgttagcgaccaggttggagaagaggcggcccaacttttcggggtcggccgtaatcgacagcgggctgggctcacaagttacgttgatcgccatccccttcttgtcggcctccagctcaaaggaggccccgacttgctcgagcaactgacccaggtcgacggtcatcaaattaaccggggcgccgtgctgttgaaccttggtgtattcaaacaggtcctcaaccaggttcttcatctgcttggccttgtcgtaggcgatgtgggagtacttgacgatgtcttcttcggactggtactggtggtcttcaatcaagcccaggtagccgatgatcgaggtcagcggggtccgcaggtcgtgggaaacgttggtaatcaactcgtccttggacttttccgacgcccgttcctcttgcatggcctgggtgatcgtgtcaaccagggcgttgaccgaggtgatcacgtgctgttggttaccgttgacacggaagggaatccggtgctccaagtgaccctgggcgatgtaatgaagttcaccaatgatgtgatccagctggtagaggtggtagcgccgcaagagccgccaccacaaaaccccaatgtcaattagcaccaacaaggccatcacgatccgttggtaggaccagatttgggcgtgaaagggcccaatcaccaacgactgtttgatgatgaagatcccgctttggaccccggggttactttgaatcatcgtttgaatgatcgtaatcaaagcgatattgatcaaccccagcaaaatgatcgttagtaagccttcaaaaaacagggaactcttctcccgcccggttaactttaacatccttttcccccattaaaaagagtggaaaataacctcctcgacaggccgtatgactaagctagggcaagggttgatgcggcacgcatcgttccttgtccatacttagacactaggcctgtggttattttccacattttctgtgtaacacctaaaaaccacaaacgcagactgaggaggttggtgagcactcctctttactaatggttttcgaccttgtatccgacaccccacacggtttcaatcaccttttcgccccccgtggcggcttcgatcttatcgcgcaggtgggaaacgtgaaccatgaccgtcttggcggagacgaccgattcttgttgccaaacccgttcgaagatgtcgtcggcgctaaagacccggttggggtggctagccaagaggtagagaatcccaaattccagcgcggtcaactgaatttggtccccctttaaggtcttaacctcgtgggaatccttgttaatcactagcggccccacgtttaagacgtcgggcttgtcgttagtgacctggttttcgctacgccgcaataaggacttgacccgcgccatcacttccagcgggttgaagggcttggtaacgtagtcgtcggccccggtcaccagcccctgaatcttgtccatgtcggccgtcttggcggacaggaccaggatcggaatcgaggaatccttgcgcacctggcgaatcacatccatcccgttcatttccggcatcatcaaatccaggattaccaaactgatgtctggcatcgtgttgagcttggtgatggcgtccttaccattgtaagccgtcactggttcgtacccttcgttgcgggcgtaaatttctagtagctgaacaatttctttatcgtcatcaacgattaatatcttcacttgatccataatggcttcccccatttcacttgcaattgttaaatctattataccgatctagcgggtgtccgcccaacgattcacggtagtttagaaaatgttttacgattttgataacggtgtgaaaggggaacaagacaactagtctgtgctacaatcagcctaacgattgcctgccaatcaaaggagggattttgatgccaaccaaaaccgactaagttacccagctcaacttgacgccccatcccgagggtgggtggtaccgccaggtgtaccacagcgccaagaccacttacgaccaaacgtccttggctagccgctacgaatacacctcaatctacttcttgttagacggtagctcgccttcccacctccaccgcctcttgcacgatgagatctggtacttccacgacagggcgccgatctcggtccactgcttttaccccaacggcttttacgaggtggttaagctcggccgcgatatcgctgctggcgaagttctccagttccgggtcccggccggcacgatctttggttccgaagtagccgatccggcctcctttggtctggtctcttgcgccgtggcccccggctttgattactacgatttcgaactcttcacccaagccaacctcttagctaagtacccggaccaagaaacggtcatcaagcacctggcttacgagaaactaccggatttttaatataaactagtctacaagcactttatttaacatactatcatgggcctaatccagctccacccctaccccagcggtaccaaaggcccgtccgaataccgtcggacgggcctttttgattacacagctatgcgtcttcccgtacatcattttgtaccgccttctccaactcagcttggtaccttttcatcgaatcatcaaagacatcgttttggtcatgctcctcaaaattacccatatctcgaatattcaagttatccgccattccccgcgaacgcttcttaataaactcttcctttgacttggtctgagaatttgtttagtggtatattggttatttaattcttatcatttaaatctcttgtattttcgaatggcatttggggagtttcttgcatatgcttatttaccattagttgttgcgggaattgttaaaattagccggaaagagaagaaaggtatatatccactaattataggaatgagtggaattgcgaatagccacttgctaagtttagtgattgtaacattaggaattggaggatatgaattatatagggtagttacaggccggttttcaaaatttgaatttaaatcactaataatttcgacatttagttcactaatgttggcatcctattccttatgggggatattttatatccaagtaaacaattctgtgattgtcccctttaaaagtttaagttacgtggatataaaacaaagtatattagcgcaactatcagggatgattacgcaaaatccatcattgtgggggataggaataatagggataatattgattgtggtcgtctctgttttatccgtaaaaatcaagacaatacgaccatatatatgtatatgtgtgttaattttgataactacatacctaccactctctaattatccaaaattaattcagtactttggatttattcagttcactggacgtttgttaacctacgttttgttgtttcaagtgatggcaatgaccatacttgttagggaattctcagggaggacaattaagacacttactatagtttgtgcgattttggtggtatgcttaggcgcaatttcagtagttaagcatgagcaaggaaagctacaagagaacgatgatttggagtcttacgtatatacgataaattcaacgaattattatcaagatgttcaggctaacaactacgataactttaacgattatcttcctggggaaggaactattggaagtggaccaatatatatccatacagatccgtggattaatttgatgcaagtaaagggagcatataaccgagcagaatttaaacttgtgtctagtaaggagggatggggttcacttgccatagcaagatataaaggaatatcttatcaggttaaactaaatggtaaaaaggtaaacttagttaagtctaatggtataaaattagcacttcccaaaggaacgtcatatctgagtgtttcaagtaaaaatacaattatgacaattatctttttcataggaaacttgattagctatttagtaggtattgtcgcagtactgatagtctgtagaaaaacaataagaagttattaaactagtcctatcaataaccgattcaagtttatgtttattaattgccttaagtagtgataatacagacactacgtttttgaaatattcattattgaggggagagattatggcaccttattcagtggatactgtaaatagcaattctttcaccttatggttagttttgttcggaaaattcattaatataaaatgggcgttcaattaaaaggaagtgtgcgtatgctaaaaacactaacaattgttgtaccgtgttataacgaagaagaagtgttcccagaaaccgttaaagagattggtactattgtcgaagatttaatcgctcaagcaaagattagtgcccaaagtaagatcctctttgtcaatgacgggagtaaggatcgcacctgggagttaatctctgagtacagcgaaaagtactcttacgttacggggattaagttcacccgtaactatggtcaccaaaacgctttgttagcaggaatgacggtagctgttaagtattcggatatgatcatcaccatcgatgcggacctccaagacgacgtcaatgccatttaccagatggttaataagtacttagaggggattgacgtagtttatggggttcgtaacagccgggatacggattccttctttaaacggcggacagcgctagcctattatgggctaatgaaacgcttaggtgtgaacctcgttccagactccgccgactatcgcttgctcagtaagcgggcaacggaggccttactccaatacaaggaacgtaacctattcttgcgggggatggttccgttagtggggtatccttcagccaaggtttactatcctcgtaaggagcgtttcgcaggtaagtcgaagtacccactcgggaagatgctacactttgcttttgatgggatttcatccttttcaatcgccccgattcaattaattttgatcttagggatcttgaccaccacgattagcatcattatgatgttttacgttctaatcgaaaagatgatgggacacgttcttacggggtggtcatccttgatgatttcaatctggttgcttggtggaattcagctaatttcagtcagtgtaatcggtgagtatgtaggaaagattttcacggaggtcaagcatcgtccgcgctttaacatcgaaacagaagactatactaaaaagatgtctaaagaataggaagaaacacgtggtcgatactagagtttcaattaaaaaactagtactacaatcaatctgattttttggtaggttaataaaaaacacttgtagttatctttctaccctaaatacttctgaggtcacagagttaagtgatgcgggacattattaattttacgttcgtaatgcttttgtttggtaggtcatttgggataaccgtcaaattttatggttcaaccgttcgctgttttctcgtatatgtggtacgtatgaggaagcgaactttctgcagcggtcgatagtactctaaaatttttggtgaataccagaacgtttttggctatcgcctcggtatcacgacttagtaagtgcctaataattatcaatagaggctaacaatcagtaaagacagctggtactttgttttgcctaagagagtggtatcgatttcgaagtgaccaatctcatgacgtaagtctgcttcgttagggctctttttaataatagaaatttacacacctacttgtaggaagtttcctctttgtggaagaccttctttaagaatagctttgatgacagttctatttgatgatgttagaattatgattcatgggtaatggactcctttggtttgatcacttaaaacaataccgagttcgttaccttttttctatctaatatcttgttcgatagaattctaggattttagattagaataatataattagggagacaataaattgatgaagacaacatatgtagggagagaatattaattggatattttaaaggtgaaaaataaaaaatgtaagaaggataacttgatactgattttagcaatgttagcattaagcttcttatttattattccgtgtttaaagacacataccatctacaacgcagatgatatgccataccatattaatagaattcaagaattggtgtatagtcttcgtcatggtaattggtatccatatatgtacactaatcaatttaaagaagttccgtatccgttagggatcttttacccgcaaataacactaataccaatcgcagttttatgtatcatctttaataattacgtgataggaatatatgctggattttcgttatatacatttatttcaatgataattatgtatgtaattgcaagaagactaggtaagagagaagcaacagcattcattatttctattgtatatacatttagtacttaccgacttctagatgcatacagtaggtttgcactaggcgaatttttagcaatgacttttgttccaatggcaatatatggattatatattgtcatgaaagatggaaaaggatggcaatggttggggatggggctttcgtttacattattgtcccatgtgctgagtgctcttttatgtgtgctttttttgacaattgaatttatattattactaccatattgtggaaactggaaacaaagtgctaggagtttaattattgctattatttccttcttattaagttcaataatctttatagcaccttttttagagcaggaagtatatcagcgtttccgacaaccaagtcctttggatctagcaacaacaaattcgattttgtcagatttgattagtaattctttaaacaataatattattggtcctagtacaggaactaggccaggtacaattggtatagtattatttgtagttatgatatggggaatgataaatgttcgtaaatccaatttaatgaataaatacattttatatgcaggggtcctgactttcatacttgcaactaacattttcccatggtctataatgatgcataccccattaaaggtcatccagtttccatttaggatattggttttcacaacattactattatcatttacagcgggacagatgtttgagagtttttataacgtaattacttcaaataaaatttcgagagttacatttgttggagctagtataataatcgtagttttcccatggtattcaagttttaagtcttatcagcatgctaaagcaaatgatgctaattttactgagaatgtttcttacgctaagggaacatgggcaactaactggtatttagatcaatatacgccagcaaaagctatggataagtaccaacagttattctatctgaaagctaaagttgataataaaacagtacaattaaggaaaattactgggaaagtcaatgaaatggagtacagagatacttcattaatgaataaaaaaacggtaactttaccagcctcagtgtataagaatgttcaaatttggcaaagcaagaaaagattaagtcataataaaaatggccttgttactattcataatactaaagtcggtacaattaaatataagtatgtaccttcaaacgttgataatatctcaagatatataagtattttaacttggcttggagtcatcttttggagttgtattacaggaacagtagatgttagatggaaacgaaaggaattcaagattggcaactaaacaacaattagaagatgcagtaagcaagcgccggacctttgcgattatttcgcaccccgacgccgggaagacgacgattacggaacagctcctcctctttgggggcgtcgttcgggaagccggaacggttaagggacggggcagctcgaacttcgccaagtccgactggatggaaatcgaacaaaagcgggggatctccgttacctcttccgtgatgcaatttgattacgatggcaagcggatcaacattttggataccccggggcacgaagatttctctgaagacacctaccggactttgatggcggtggactcagcggtcatggtgattgacggggccaaggggattgaaccccagacccgcaagctcttccaaatttgtaagatgcgggggattccgattttcactttcatcaataagtacgaccgggacgcgcgggaaccactcgatttgatgaatgaaatcgaagaaaccctcgggatcgaaacttacccgatggactggccaatcggaatgggccgtcagttcatgggggtttacgatcgccataaccaccgggtggccttaactcacccggccgatgaaagcaagccgtacttaccgttagatgaaaacggggaagtgattggggagaacccgttggctggcgaaggggaatgggaagacgccctggaagggatggaattgatctctgaagccggcagtgaattctcagcagaaaaggtggcggccggggatcaaaccccagtcttctttggttcagccctaactaacttcggggtcaagaccttcttggaaacctacctgaagtacgccccggcaccgagtgcgcacaagacggaggaagggaaggcgattgacccgctctccccggaattctctggtttcgtctttaaaatccaggccaacatgaacccgaagcaccgggaccggatcgcctttgtccgggtttgctcaggtgaatttgaccgcgggatggacgttaccctggaacggacgaagaagccactccggctgtcgaacgtgaccgaattcatggccaacacccgggaaaacgtggaaaaggccgttgccggcgatatcatcggtttatacgataccggaaacttccaaattggggattccatttacactggtaaggaagacattaagtttgaaaagctgccgcagtttacgccggaactctttgttcgggtctcggccaagaacgtgatgaagcaaaagtccttccacaaggggatcaatcaactagtccaagaaggggcggtccagctttaccaaaattacaacactaacgattacatcttaggggccgtgggacagctgcaatttgaagtctttaagttccggatgcaaaacgaatacaattccgaagtcatcatggaaccaatgggcaagaagacggcccgctggatcaacccggaccaattggacccgaagatgtcatcttctcgcaacatcttggtcaaggacatgcagggcgaaccgctcttcttgtttgaaaatcaatttgcggaaaactggtttaagcaaaagtatccggatgttgaattaacgtcgaagctatagggaagatcaaatgtttaagttaaatagttctagaaagaaagatgtaattgcattggggatttgtttattggttacttttgcaatgacctttcctctctggaaatcgcagcaactacttatagctaatgattggtctttccatgcttcacgtgttgaggaaatttgtgagaatttaaaatcgggacatttttttacctatattgctactcacacttttcaaaaaacgggtgttgctaattttatcttttacccaactattttcttatacccatgggcatttttaagattaattttaagtccagtagtagctttttatagttggtatgcactagtcaacctagggacattagttatcacttactactgtgctaaagaagtaatggggagttgggtgaaggctctcttagtagctttaatctacgtattaatgccataccatatatttgttgggactggggtctttggcgaatttttagccatgacatttatccccctagtgttattagggggatataatttattctttacaggagaacatccgtggaaacttttggctgtaggtttgacattggtcggctattgccattttttgagcgttatcctttgttgcgaggtattagcaatcttatttatcttatctctattaatgaaaaaatggggagacaagaaacgatggctagctttactaaaagcagttggattgacgactattctgatggcagggataatcgttgcttttcttacaaactacatgggccaaaagataattagcacaaacgatgtttttaattatgcaatgattcagcctcttaagaattttatctttgattcatttggcgttggatatggtcaaaacttaggaattattcttatagtcgccgcatttacaggatttgcaacaagttcaagtaaattttttaaaatagtttggtttttaggcgtagtcatttcattcatggttacaagtgactttccatggcaacttttaaataattacattcgagaactaggggtaattcaatttacttatcgttatttaacgtatgctggaattttattatcgttagtggccgcggatgcaatcgggcaacttgttgaaaatcaagaggaaagatctagaagtaaggggttagtacttttagcagtgacgttcgtagcagttttatacccactttcaatttggcataatggtgattggactagtaatcctgcttattcaaagattgaacgtaatgattttaaggggactgtgaaaggtacggaagctatttaccgggtagacaatcaaacatattcacagattttctcgcacggagttttatatggtgagggagattattacccgagtgttgcaagagctggaaataatgaggctttttttggagacgtagtgaagaattcattgacgcgttcaattgttgatggagttacgtatgttgatggtaaaaaagtaatagctaaacaagtatctggcgcaaataaaatcacttatttactaacagatgccaaagataaaactgtagacctaccatttttggtttataaaaatacttatttgaatgttagcggaaaaaatgttgcctttcaagtaagtaagagaggaacggtgcagtttaaggctaattcaaataaagttgaggtaactgtcgggtatttaccttcaatatcgatgatagttagcttactggttaccattataggatgggtagcgttgattgtttggtggatattcagtatgattcatgggcaaagcatgtcataagtatcataatacttacgaggaaagattatgattgaaaaaaaacttacggttatcattcctgtatacaataatggagaattaactcgcagggcagtgaggagtgtacttacataccctaaggatgatcttgaagtattggtggttgatgatgggtctactgataatgctacggatcacctccaagaactagattcaagaattaaggttataaaaaagagcaacggtggggttagttcggcgaggaatttagggattgagagagctttaggaaaatttatccttttcttggatgccgatgatcaattaaccgcagattggggacggcaagtatcagctttaacggatcaggagttagttctctataactatgaaacaaataagggaaccgttaagaatatttctgagtcacgacaattgaatggccaaccttttcaggagtaccgatgtgcaatgattgctaatccaaccaaaaatttaatggtatggggtaaatttttacgtaaggatattattgaccgtgagcaattacgatttgatgagtcactatccttagcagaagatggcgattttatggtggcatacctattaaaaattcatagtgtaagcttagttgcttcaaccctatatcgttatttagataatacagattctgttatgcggactttcgatggtaagaaggtagcgggttatcttaaagctctcagaaaaatggaaatgagattggcagatcaatcaactgatttaaaaaaagccggtgctctttatgtgttaatgcatgtaaacgttatgatggttcgtgaagtttacgacattgataatttagcaacgccaagccaaaaaaaacaacagatgctcatgcttgtaaaagagccggtcatttataatgctttaaaaaagattagtttaagtgaatgtggaaaacctcgattaatccctattgcattacttaagttacattggtatgacatggcaagattagtctttacaatgcgttcgaagagaaaccatgcaagttaatacttagatgcgaaaggattagtagaaagatggtagttctagtaacaaaggtaataatatttttggtggtagggagtattagtactatccaattagttttgaatgctaaggtaaggaagttaaagttatatgattatgtaatagttattctcttaaccggatatacattatatttactatttaaattaggcagtcatccggatcttttcctggatgaaggtaacgggatgtacgatagttggagccttgctaaatatggagtggatagcaatttaattcacttgcccgtgtacttggagtcatttgcaggtcaaggtcagtctgtcctctatgcataccttgccatcccatttttcaaaattttcggatacaaaatatttgcatttcggctagtgattctaattacgagtattgttaccatcttggttttacgatataccttggagaagataactttatcaagtaagcagattttctttatcatgctagttgtatgctcgtctccatggttattaatggtctctaggtggggaatggattgtaacattgcaccttttccgatcgttttaggatcctgcttaatttatttaggcacattgaatgggaaactcattcgtcaaacctttctgtacttattgggtgtgataatcctttgcttatcagcatatgggtataacgtagcgtggtttttcttaccgatcgtcttgttaatcatgatgattacactcattggaaagaaaaaaattaatctttaccaaattttcttatgtgtgattgccgcactggttgagctaacgccgattattatatttgcggttagaagtaatattccgtcactaaataaaactgttcaaatccttttttggacgtcaccaaaactacaaagcggtcgagctggtgcatcgttcatcagctttagaggaaacattattaaaaatatttttgaaaacctctatgcaggggcaaatatgttcttacatggtagtgactcgcttgcttggaatagtgttccaggttacggagcgtattatgcatttgcgttaccattctttttgatgggactctatgtaattattaaacgacggaaaatatatgatcggttcatcttggctaatttaattgctgtaattccgacgttaatgattgtggttcctaactataaccactggatattccttcattttccggttttattgacgatcgcaattggggtgaatcttgttacgcaacgagtacgggaaatcgtcccagtaatgatagtgacatatgcgatcagtttaggaatgtttattccggcttacttcaatcaggcagggacggggtggataattcagtcagccaacgttttaaaaacgctggaaactaataattataagaaagtttactttacaagcagtcaaggcgattttttattgatggttcgcgattttctacctgtttcaccatacaagtaccaagcaacgaaggatcatccttattcaaaaactattttagctgtatcgtcaaagtatgataattttgaaaccctaactcctgaaacaaaggtaaaatcaaattcactaattttggtggatcaatcactactaccccaggttcagggaatgttgggcaaagataagtatcagaaaacggtcacgatcaataatattaagtacaacgtatactaccatgcttagcccaaaaggaggccccactcatgaacattctagtcaccggcggggccggcttcatcggtagccacttcttgcgctaccagctaagtcactacccagctgatcgggtggtgaacctcgattgtctgacctacgccggcaacttggcgaacgtggcggatttagcttctaacccccgctaccactttatccagggtgatatccgggatgccgctaccgttagcgaagttcttactacgcaccaaattgacgtggtggttaactttgcggccgagtcgcacgtcgatcgttcaattgaagatccggcgccctttgtttcgacgaacgtagtgggggtgcaggtcctcttggatgcctgccggagggcgcgggtccgcctagtgcaggtttcgaccgatgaggtgtacgggtcaattgcggcagggcgggcggatgaagaagcgcccctccagccgagttctccgtacgcggcgacaaaggcttccgccgacctgttggcaatggcggcccaccacacctttggccaggacgtcgtgatcacccggtccgctaataactacgggcccaatcagcacccggaaaagctggtgccgatgatcatcactaatgcccgtcagcagcgaccgctcaccattcaaggcaccggcgatgacatccgcgattggctgtacgtggtcgataattgccaggccattgacttggtaatgcgcaagggcgtggcgggggaagtctataacattggcggctttgaacgccgcacggtgttagaagttgtggccagcctgcaagcgttgctcggctttcccgcttcccaagtggttcacgtggctgagcggctcggccacgatcaccgctacgccgtcgatgataccaagttacgccgggcgttgggctggcggccatccaccagcctcgccgccggtttaaccaagaccgtcagggcgttgcaacattaatcaaaaaggtcccttacaaggggcctttttttgttgacaggaaacttagttggttatatagttagttacacaagtaattaactaactaagttgccgaaaggaggggcccatgaacttcgaatttgatcaggacagcccgctgtaccagcagattgccaaccaattggcggagatgatctttaccggcgtctaccaggctggcgaccaggtgccatcgaccacccaactgtccgccagcttgaacatcaacccggcgacggttttgaagggtatgaatcagctggtggccttgggcctgttagaaaagcggcgcgggcgggggatgtttgtcaccccgggcgcccaggaacaactggccaccaagcaccgcgatgacttctaccgcaattacgtggtggcgatggtcgccgaagccaagaagctgggcatcaaagaggagcacttacaggaactaatcaaacgggggtatcaagatgacggtcaatgaactaatgattaaccacgtcaccaagcgttaccggcgccacacggtgatcgatgaagtgagtttcaacctggcaccggccaagatttacggcctgctgggacggaacggggcggggaagagcaccctgttaaacatcatcaccaaccggattttccccaccagcgggatggtggcgatggggccacaaaacgttaataacaacgatgaagagctgggcaagatttacttgatgagcgaatccaatatgtacccgaagacgacccgggtgaaaagaatgttggccgatgctgaccgcttctacggcaagtttgacttcgctaacgcccgccggatgctggggcagtttgggatcaacgagaaggcccgcttctccaacctctcaaccgggcaaaagacggccgttaagatcacaattgccctaaacgtcaacgctcagtacgttctcctggacgaacctaccttaggcctagacgttaactaccgggaaaccttttaccgtgagctgttgcggacttacagcgaaaagccgcggacctttgtcctatcgacccacttgatcagtgaggttcaacagctagtcgaagacgttttgatcctccacgaggggaagatcatcgtcaacgaaccagtggaagaattgttgggccgggccttcctggtgtcggggccggcccagttggtggacgaatacaccgccgggcaaaccacgaccgacagccaaacgatcggcaacctgaaggaaacggccgtgattggggagctggacgccctgcgtccgattcccgaccaggtgcaaatcaagcacttagacctgcagcgggcgttcaccgccctaactaaccactaaggggggagtaacatggaaaagttaaataagcagtacttaaagcagctgagccactacagctggctaaccctgatctccattatcagtatcctcggcgtctcggcggtcttctacttactagtaatcctcttcagtggtcacattgatgtagaggcggtcagcattagtataggtggcgggaacttagttgccatgctggcctttttaagcgacgtgatggtgttggtactcgttatcttcagtatctgcaccccctaccagatctttaaagaagcaattgccaacggcgtgtcgcgctggacgaactggctggcccatcacctgatggtgatcacggtcctggtggtcgcctggttgatgaacgccttgatcgagttgctccaaagtggcaccgtcacttggagccagcggtgggccatcatcatctcgatgctgatcggggtgacgacggccggagcgctggggaacctctacgggctgatgagcatgcggtggaagatcatcctaacgattgccctgctcgccagtttcttcgtcctctgctggttggtggtgcgcctggtctttctggtcacccccgagcgggcggtcatgatgatccaatcaattaaccacccgattgtttggaacggcctcggcctgatctgggtcgccttgatggtcggcattgactacctgtgcgccatgcacatgcagctgcgcagggactaataccggttattgaccacgtttttggtttaacattcagaaagacaataagagcctgcgagaaaagcgtgatttctcgcaggctcttatgctttactaaaatgggactaaggggaaggagggctacagatggaactagagcaagcgtcgttcttggcttccccggaagccttggcggctaaacaagcggttgaagcgggggagaccgaagtgattgggtcgctaacagattttaactggctgagtgacgaactcgctgctaagtaaatgaatatcttcaccattaaccgagtatcttggtcatttcgccttaaatgaccaagatactttgcttatgactaagatacgcaaaatcccggtgggggtcaatcggaagttgattgagagagtgggaaataacctactcggcaggtcgtatggctaagctaggacgaatggttgatgcggtacgcatcgttcttcgtccgtacttagacactagacctgcggttatttaccacgttttctgtctaacattcgggaataaaaataagaggctgggaaaaacagattttttcccagcctcttgttggcccttatttcttttcgacgaagaacttggcgaagtttttagcgtaggagcggttgatccgcttttccatgatccagcgcttgaggttcatgtcctcagcgtagtggaaggtcgtcccccacttgccggcctttaagagttgcttagcgacttccttggcctcgttttcgcgggcgtacttgaggaaggtttgcttagaaactcctaaccacagttggtacttgctttcgtccttgaaggccagcaccggttccttatcctttaaggtcttggtgatgtagtcttcaaccgggtaggacggcaggttgtagccgtttaaagaaacgaagtaggagctgcggccctggcgcgggttcaagtcaaagaccttgaacttgttatcgcggtggtcgaacttgaggtcgaagttgacgtagccggtgaagtcgacttgttctaagaactgcttgatgtcgtggtaaatttgctcgttatactcgggcaagatcgccacgtaattgccgacgttgagcgggttgcaatcctctaacaagggattacctagcgccatgagtttcacctggtggtactggtcaacgtaacagttgatcgtgcgcatgttagagtcatcgccaggaatgtattcttggacaatcacgtcgcccttataagggctgtgttggtagataatctcgagaacttcgtgtaagcgggcctggtcgttaatgatgtaggccttttcgtaaccttcaaagttccccttatgccactcgacggcgtcggcggccttgagggcgatcgggaagccaaacggcgactggtagttttgccagtcggtgtccggctttagaatcgaggtcttcgggtacggcagtccgtacttttcacaggcctcgtagaaggtttccttgtcggttaagtcgctgaccgtttcgtagtcggcgtagggcgtcaccatgtggtcgaccagttgcttgcggtttttggccactagctcggtgtaatcgtcgccacaagagatcaacaaaggggtgatccccttttcttggtattgatcggcgatatcgatgatcgtcttggtaaaggtgctagcgttcatcaagtccgggacgtggtggaaattgatgattttggaatacttggttggtgcgaggctcccctgggcgtaaacttcggacttgaccccgtaagccttgtacagctcgcgggccattccgtacgcgttaaagtcgctccccagaatcagtggaacaaattttgcatccacgatggttcctcctctaagttaattatttgtaagacacaagggacattttaccattctttgctagtgaagggtagcccgccgtcagtggctgaagcgggaaaagttaatttgcgagatcaggttggccacgaccaagagcccgccgccgatcaaaagcgaccaggtcagccggtcaaagcccaagaggaccgaaaagaggctggaaaacagcgattcggtcatcatgatcatcccggcggtcgtggcgctggtcaaacgctgggcgtaaatctgcaacagctgggtcatcagggtcactaataaagcgacggtcagtaacggtggcagcgcccttccccattcgatgccgggccactggctacgctcgaataagaccgagtagctcatcccgccaatgccctgcaacaagctgacccaaaagaccatcacccagggcgagactttggtggccgcaccgccgtagtacaggatctgaatggcgtaaaagaaggccgccactaagacgattaggtcgccgaagtgaagggtgaatccggtctggaccaaccgggttaagatcaccatcccgatgatggcgacgccgaccgcccagaagtcctggcggcggggccgttggtggcccagccaagctaggaaggggaccatggcgacgtaggtggcggttaaaaaggcgttgttggccggggtggtgtaaaagaggccgatcgtgccacactgaaaggcgatgtagttgatgattccggcgacgatgccgacgtgaacgtcgtgggcgctcatgtggcgcaactttttaaaaaagattaggccgacgaagctggcggcgatcaagccccgccagccgttgatcattccggccggcatctgggcgttagtgaccatcttcatcaagacgtaggagctcccccagatcgcggcgacgacccagaggatcgtgttaccgaccaggcgcgggtgcttaatcgacatagtggcccccggaagcctggtcgacggcctcaatcaagccggctcggaagccgtgctgttcgagggcgtcaatcccgcggatcgtggtgccacccggcgaggcgacttggtcgcgcaagagggccggggccaggccggtctccagggctagtttcccggtcccggcgaccatggcggcgataacttggtaggcgacttggcggttgagcccgtgcttgaccgccccgtcggacagggcgtccatcatcacgtcgacaaaggccggaccgcaaccgccgatcacgcccacgacgttaaggtctgcttccttaacttcaatcaccgtgcccaggctgcccaagacctccttaatcagggtgccggccggttcaaccatctcttgcggtagggcgaggccgatcgccccggcgttaacggcgaccggggtgttggggatcatggtggccagcgggcggtcaccgaggaccgcttgtagctgctcttgggtgatcccggcggcggccgaaaccaccggggtggtggttggtaggttcgccagcgaccgggcggtggcgacggtcaagggcgccggggtggtgaggatcaccaagtccggggctaagttgaccaaggcggccggatcgttaaccaccgtcatctccaggtcctcggccagctgagtgacccgcgggttaaccgggtttaaccccagtaattggtattgtttagtgttatatagccccttggcgatcgcgccccccatggcgcctacgccgacaattgcaattttttctgtcatcttcttctccttaatcttcttccagttttaagtaggaaccgttgatgtagccgtgatcgacggcctcgtaccaaacgaccccgttatcatccataattttaccagtcaggatcagtttctgaccgtcagccacctgaccgatttccgttccgtaggcctggtcgtaaacggcgaccttaccgttgggcacaaagtcgaccgtcgccggcaagtggttcaacttgaggtaggtgaagtcgctctccaggttggcccggaccggcgacggctcatcggcgtaagggtcgtgggccaacacccgcagatggtcgccctccttaacccagcggtcggcgttaatctggtaccagaggacgtggttggtggtttcgattagctggaaggcccgcaaaaatagcccggccggcatgggtgattccaccggcatcccgtccacttggtcgaagagggtggtcggggccatcgtttgtaagtacaggttcacgtctttgatcttgtgccaagtttgcttccggtagtacaagtggaccgtcttttggcggtcgtcaaaggtgccggtcaaaggaccagtcgccttaaagaatttatagcgcgggatgtccaattggtgcaccacatactgttcgcccgccatgccctttaagagggttggcacgcgcaggttgataccggtatcaacgtcggtgtagtaaacccaaattggattgccggtccgaaaatttacgcccataatttttcaccccatcagtttttcgtttttcaccaagtataccgcaataaagcgcataaagtcgcctgatcgcccggaaaagagcccgcaaagttaggaactgtggtaaaatattaaagattatttaactgagaatggtatagaggagaaatggaatgcaaaatcgtcaacagattcagcgcttgaccacgcaggccctgctgattgtgatcatcgtcttacaagacctgatcccgatgattggaaacctcccgctcggtcccttatcgattaccaccttaccgattaccgtcggggtggtggccgttgtctgggggccgcgggaagggatggttgtcggcggtgtctggggcctgttgacctgggtgcgggcctttgtttacccgtccagcccgctagcgccgttgattttcactaacccgctcatttcgtttgtgccccggctcttaatcgggctggtggccggctgggtctttatcggcctcaaaaaggtggtctcaccaagtttggcggcctgctttgccgggctaatgggctcggtcaccaacaccgtcttggtgctcggcggtatttacctgttcgctaacaccccggcggtggcgagtgcctatcacgccaccaccagcaacctggcgaccgccctgctagcggtggtaaccactaacggcctggttgaaatgctggtcaccgccctggtggtcccggcgatcgccctgccggtcgtgcacgcgttaaaaaaggatcaataaataaaaaatgctggagggaattcatttccttccagcttttttagttagcgtggtggccaagggagacacgacaaatctaaaattgggcgcaaaaaagagtgctcctcaatctatcaaacaggcctagcttagtcatacggtttgtcgaggaggttggtccgcactttcccataacgtgctccccaaccgcaggcctagtggctaagtctggccgaagaacggtgctggcgcaccaaccgttcgccctagcttagccatacggcctatcgaggaggttggatcgcactcactgctggtgctccttcattaactcctgttgcaaggcggccaacttaggggagaggtagaccgggtaagcgtccgggttgaccaagcgcttggtggcggccggtaactgggctaattgtttctgggttcgttcctggatcgccagcacgtcggtttccaccggttgggcgtccttactaaccaccgggacttgcagcggctgggccacaaagtcggttagggtgagttggctgaatgtggagagcgggtcgacgttggtgaccgttagcggggcggtgagttcttcgtcggccagggtaatcacgtcggcgaaggcggttttggaatgggggtggaagaggcggtaggtctgtttcttacccggcagggtgatcttggaccgtgagttggagagtttgatcttgggctgccaccggccgttttcggtcagggcggccattttataaaccccgcttagcactggagccgaaccgctggtgatcaacttgtcgccaaccccgaagttatctaagggcgctccttgttcaagcaaggaggagatgacgccttcgtctagcgaattggaggcggtgatcttagcgttcgggaagccggcttggtcgagcagttggcgggcggccgtagcaagttgggcgatgtcaccggagtcaatccggatcccgaccggctggtggccagcggcttgcagctccttgaagaccgtgatggcgttggggatcccggactttaagacgtcgtaggtgtcgaccaacagcgaggcgctgtccgggtagaccttggcccaggaccgaaaggcggtcagttcgtcgttaaaggactggacccaggcgtgggccatcgtgccggcgaccggtagttggaagagctggccggccaagacgttggaggtgctagcacagcccccgatcacggcggcccgggcgccataggtagcggcgtcgggaccctgggcacggcgggcaccgaattccatcaccggacggcccgccgctgccgccacgatccgccgcgccttggtggcgatcagggactggtggtttaagatgttgagcagccaggtttcgatcagctggcactggatcaggggggcgcaaacggtcaacagcggttcgcgggcaaagaccggggtcccctccggcatggcgctgacggtcccggtaaagtggaagtgggccaggtagtcaagaaagtctggttggtagaggcccagtgactggaggtaggccaggtcagcggcggtaaagtgcaggtccttgagttgatcgacgacctgggccagcccggcggcgatcacgaagctgccgtcgtcgggaacggtccggaaaaagacgtcaaagaccgcccagcgatcatcgggcagggtggccaggtaaccgttggccatcgaaaattcgtagaggtcggttaacagggcgtggttattcatttggttcaccccccaaaaggacttcggcgcctaaaacggtttgaaaatgttggagcgcccattcttggccggtgggagtcagggcggcaacggcatcctggtagaccgttagtttgtagccccggttgtaggcgtcgacggcggtgtggaggatgcagatgtcggtacagaccccggttagggcgaggtgacggatgccgcgctcctgcaagaagagttggagacgggtgccgcaaaaggccgagtaacgggtcttatcgagcagcacaacgtggtcgttagcctggtgggcttggtaccattccttaagcgggccgtagaactggcgcccccaggtattgcgttggttgtggggtgggaagagcttgctctccgggtggtaggggtcgtgtggctggtggacgtcggtcggcaagatgacccactgaccggctttgagggcccggtcggccaggctaacgatggtggtggcgatttgctgggccggttggccacaggtcagggcgccacgctcgtcaacgaagtcgttagtgtaatcgataatcaaaagggcagttggtgattgcatgctgaaaacctccttggtgagggtgttgcgtgattaaagtaaaaaatacctaaacatgagtaaaaataaaaataggaatgacttttattccttgcagtcaatcctactcctttgctggggacttggctagccccggagccgatatattttgggcggacggccgctttgcttgggggtggcggtgccgcactcttcaaacaggtgggcgtgggtcttgcggaagttggaattatcaatcgccgccggggtggttttcaaaaaggtggcgtaaacgttgcgggcctcctttaaggtgaactgctgacccaggatcctcaagacggtcggttggtaatcgagcttattttggatccgggtcagggcggtggcgatgatttgatcgtggtcaaaggccagtgccggacgatttaaaataaaggtgcggcgcccattttgcaaggtgtcctgctcggcggtccgccggagggtaaaccaagcgacctcgctggccccgtagcccggggtcaaagcgggcatcgagggtaaaaaggtcatgtaagccagggccagggcccgctcgccggggacgcggtcgggggcggtgaaggtggccaactgttcggtggccgccaggctcagctccaggccaatcttatccttgatcaggcggattgcggcgtcatcagcgctttcgtggcgccgtaataaggtttcgggtagggcccaggagtcggcaaacggttcttggtcgcggcggaccaagaggagctggaccgtctggctggtggcgtcaaaggaccagatcaggttggtgaccgtgattagcggccgggtgaggagttgttcgtcgctcacgaaatcattcccttcagagagtgggaaataacctccttggcaggtcgtatgactaagctgagccgaacggttgatgcgggacgcatcgttcttcggcctgcttaagcactagacctgcggttattttccacgttttttgtcttacattcgaaaaacgaaataagaagctggggcaaacagatttttccctgcttcattttagcataaaaaaaggttccacttttggaggcaaagcgggacccaattggtgcgttattcttccgccttagcgtcggtggcggcgtccattggtgcggcgatcgccttttgcgtggcggccacggtgatcttgccggcttcatcgacttgggccaccaggttggtagcgtccgggtggtcgaggacgtaatcggcgatttggtcttcgatgtgttcttggatgacccgccgcagtggccgggcccccatcttcgggtcaaaaccgaggtcaactaagcgttccttaacggcgtctggcacttcgatgtggagcttgcggtcggctaacatgttgttaacgtcgtcgatcatcaggccgacaatcttcattaagtcgtccttggtcagggcgttgaattccacgatgtcatcgaaccggttcaagaattccggcttgaagtagttggtcagcttggagatgaccgacttggtttggccggccgcctcggcgccaaagccgacggaggcgaccatgtcaccagtcccggcgttcgaggtcatgatgatgatcgtgtccttaaaggaaaccgtccgcccttgcgaatcggtcaagcggccgtcgtcgaggatctgtaagaacatgtgcatgacgtctgggtgggccttttccacctcatccaaaaggatcaggctgtacgggtggcggcgaacttgttcggtcaactggccggcctcttcgtaaccgacgtaacctggggcggccccaatcaacttggaagttgaggtcttatccatgtattcggacatgtcaaagcggatcatggcgtccttggaaccaaagagcagcttagacagttgcttagcggtttcggtcttcccaaccccggttggcccgacgaagaggaaggagccgattggccggccggacttgtttaaaccaatccggttccggcgaatggcgcgggcgatcttgtcaacggcttcgttttggccgatgacgtggtcttcgagctgcttatcgaggttcttgagttggttttgctcttgcttttgcaggtcgctgaccgggatgttggtcatctcttcgacgatcttttgcatgtcggcggccgtgaccgtggcggcttggtcggtgtggttttcctcggcgtccttcttggccttggtcaacctataaacctggtcgcggtagaaggcggccttttcgtagtcttgtgattcaacggcctgttgcttgtgggcttcggcggtgtgaatctcattttcgatagtgtgcgggtcggcggtctttaaggttaggttcttgcgtgaaccggcttcgtccaagaggtcgatcgccttgtccggcaagaagcggtcctggatgtagcgatcggatagcttagcggccgcctcgatggcgtcgttagtgtaggtaacgtggtggtaatcctggtagcggcccttgatcccgtttaggatctggatcgtttcgtcgacggacggttgttcaacttcgaccggttggaaccgccgggccaaagcggcgtccttttcgatcttgcggtattcgttgagggtggtggccccgatcagttggaactcaccccgggccagggccggcttcaagacgttaccggcgtccatgccgccctcggcgttgccggcacccataatttcgtggatttcgtcgatgaagaggatcacgttttcgtccttagaaacctcttggatcaactgttgcatccgctgttcaaactgaccgcggattccggttccttggaccagggagacgacgtctaagcgaataacttccttattagctagcttttctggtacctgaccggaaacgatggcttgggccagcccttcgacaacggcggtcttaccaaccccggcttccccgatcaggaccgggttgttcttggtccgccggtttaagatttcgacgacccgggcgatttccttatcgcggccgatcaccgggtcgatcttgccttggcgggccagctcggtcatgttaatcccgaactgggctaacagtcccttgccgttgccgcggccgccgccttggcgttggttttgattcaggttggcttgttggccttcgttgttgttattggcttgttggttttgcatgttgttcatggcgttcatgaagtcttccagactcccaaagccgaatccattattcatatcactgcccccgttcaacaggttcatttgcatgttttgcattttttggtagcaatcctgacataagtcgatttgcattttttgcccgttcatcatcatttggagatgaatcgtggcttggttttgttgacaaacttgacagagcatcaattaatcccccttcgtttgggtcaacctttgacttttcttgaccattgcctatattatacttacttttcgtgggaccgcaagtcatttcaaccgtaattgaaagggtgcaccccttcaaataaaaaaattgaacatgtaagggctcccgttaccgaaaattttagcactgattggcaactaatgctaaaatgagtgctaaccacagtataagagggggcatcaacttggcaactaaggaagactttgtacgtcaattagccgatttacgtgacggaaaaattgaagaactactcgtcgaaccagataactttatggcctttcagcaggcttaccgggagagttcctttcgcagccagattgaagggcaagccggacggggcggtcaaattcactaccgcttcaaaactgactaaaagttctggtggttcgccttgtatttaccgcttacaatcgctataattaggtaaatagtgagtgttggccaaatgagatggtgtcttatgtttaccaacgctaaatcaacactaaggagattgattataatggaaaaacgcgactttacgattactgccgaagctgggcttcacgcccgtcctgcaacgatcctcgttcaaacggcatccaagttcacttcagacatttcccttgcttacaacggcaagagcgttaacctgaagtccatcatgggggttatgtccctcggggttggccaaaacgccgacgttaccatcactgccgaaggtgacgacgaagcgaaggccatcgaagccattgccgaaaccatgactaaggaaggcctggctgactaaaatggtcaccgtactcgacggcgtggccgccggcggtgggattgccatcgccccggtctaccggttgggtgaatcgcggtttacggttaaagctaaatacaccgataatgtgaatcatgaggtcagccggcttcatgattctttttcgttagcaagacgtgaattgacggaccttcgtcggcaggctcaccaaaagatgggggagaaggccgccaccgtgattgacgcccaattagcaattgctaaggaccaaagttttgaaggggagatcaccgacgccatccaacgctactcgacgacggcggcctggacggcgacccagcggattgaccactacctaaacgtcttcaagcgccaatccggcggggcggattactaccacgcacgggggctggcgctgcaggacttcaaaaagcgcctcttggcccacctattagatgaagaattgccggacctggctaagttggatcaccgggcgatcatcgtcgcccaccaactgacgccgaccgacatcattcgcttgaacccacacctagtcgccgggattgtgacagacctgggtggccggaccgcccacttcttggtgatgagcaaggagatgagctttcccaccgtggtcgacaccaagacggtgaccgaacacgccgatgacgacatggttgccatcatcgacggtacccacgggcgggtgatcttgcaaccgacccctcagcaaatcgatcagtaccaacggctggctagccgggagagtgcccgcctgcgcgaactgggcgtcttaaagcaccaagacaccgttagcgccgatggtcaccactttgaagtggccgccaacgtcgctttgccacgcgaaagcgacgaactggccaccagcggggccgagggggtcggtctctttcgtagtgaatttcttttcttacaccaagacaccctaccggacgaagaaacccagtttcaggcctaccggaagctgctcttggctgccaacaaccaccgggtggtggtgcgcacgctcgacatcggcggcgataagcaactcgcccaggtgcccctggaacgggagaacaaccccttcttgggcctgcgcggcctgcgggttagcctggcctacccggggctatttcggacccagttgcgggcgctcttgcgggcctcggcgtacggccagctagcgatcatgttcccgatggtggcgaccgttgacgagttccagcaggcccagcggatggtcgatcaggagaaaaaccggctgacccaggagggaatcccggtcggcaaggagtatgaggtcggggcgatggttgaaatcccggccgccgtggcgatggccgaccagttggcccagtacgccgacttcttttcgatcggcaccaacgatttgatccaatacctctttgccgtcgaccggggcaacgggcaggtggcgagcctctaccagtccctgcacccggccgtcttgcgggcggttaagcagacaattgattgtgcccacgcggaaggcaagtgggtcgggttgtgtggcgaaatggcgaccattccgaccgccgtgccattgttagcggcgatgggcctagatgagttttcggtcccgctaagccaggtcctgccggttcgctcgcagatccgccgcctcaaggtgcggcaactgcagccgctgattcaccaggccctggctgcccacagcccggccgaagtcagggcgctggtcgatcaattaaccagtcacatgaagtaatcaacatattaaggaaagcttaacctgcctaccaacgaccaggaagctggaaaaaatagaaacggggtgtcgggccgaaggagccgggcaccccgtttatgatctgacttgccccggggataggaacggggctaaaatagcctaaattgcgcctgaaaattccctttagtataattaactgtagtttattgcgaagaattaaaggagccgaagctttgaagattggtttgtttacagatacgtatttcccccaggtgagtggggtggccacctcgattaagaccctgcgcgatcaattaaccgcgctgggccaccaggtgtacatttttacaaccaccgacccggcggctgatcccgtttcggaccaggcggagggaatttaccgctttgctagcattccctttgtctcctttaccgaccggcggattgccgttagcgggtggctgaaggtgttgcggttagctaagaagctcgacttagacgtggtccacaaccagaccgagttttcgctggggatgatggggaagatggtcgcccgggaaatgaagatcccgtgcctacacacctaccacaccatgtaccaggactacctccactacatcgctaacgggcgggtcttaaagccgcgagacgttgcccacctggctcatttttacttaaagaacatgaccggggtaatcgccccgtctgaacgggtcttagacaccctcttgtcctacggggtggaagcgccgatccgggtgattccaaccggggttaacctacaagtcttccaaacgccggatagtaaagaagagatcagcgccctgcgccaaaagcttggttacaccgatcaaacgccggtactcttgtcgctgtcgcgggtggcctttgaaaagaacattcacgccctcgtggaagccatgccggacattttggaaaaagagcccgccgcccaacttttaatcgtgggggaggggccggcgcggccaaccctggagcgccaggtgcgcgaaatggggttgcaagaccacgtatcctttaccggccaagtggataacgatcaggtttgtcactactaccaaatggccgacgtcttcgtttcggctagcgattcggaaacccaggggctgacttacgatgaggccttggccagcgacctgccgattgtcgtcatgcgttccgagtatacggacgagctaatcgatgacccggcgattgggcgttcctttcaaaagcgcaccgacctggttgacggggtactggaatacttggccaccccgccaagcccggaggcgatcgccaagcgccgcgagaaactgcacgatatctccgcggaggtgtttgggcagcgggtgcttgatttctaccgggtctgccaagaggaagtggcggaaaaaaagcggccgggctttgggcgtcgttttcgtcatttgagggaccaaaatgattaaaattaccatgtattcgtcggctgacaaggtggcggggcagggggtcgggagcgcctacgcggagctgatgaccctgttaaaggaccgctttgcttcccagttcgatattcaaattaatgagtttagccgccaaaatgacatcagccactaccacacgatcgacccccgtttttttgtgtcgaccttttccaagaaacggggccaaaagatcggctacgtgcacttccttcccgagacgatggaaggcagcctgaagatcccccaaccgtttcgggggcttttttatcgttacctgattgccttttacaagcggatggatcacctggtcgtggttaacccgacctttatccccaagctggtggcctacgggatcccacaagaacgggtgacctacatccccaatttcgtcgatgaccagcgcttttacccggtctcggcggccaagcggtgggaactgtaccggcggtggaaactggatcccgagcgcttcacggtcgtcggtagcggtcaaatccaagaacggaagggcgtctttgatttcatcaaactagccaaacaaaacccccactttcaattcatctgggccgggggcttttcctttggccggatcaccgatggctaccaagagctcaagaaggttgtcgctaacccgccggccaacctcttgttcccggggatcgttacccgcgaccagattgccgagttaaacaacatcgccgacctatttttattgccttcctataacgagctcttcccgatgtcggtacttgaagccttttcgtgtgggaccccggtcatgttgcgcgacctcgatttgtaccactcaatcatcggcggctactaccaaccggctaaagacgtcgaccaaatgcaagcagaactagtgcggattgcccaggatccggtcgccctagctgacctaaagcaaaagtcactaacggccgcccaacgctactccaaggaccacctggctaatgagtggtaccacttttatcgaacgcaaacggggagggaataggatgtcgcgaaaaaactgggtcgttttgatcttgatgctcgttgccggtgccggcatcttcgccttttcgttgcgcaacaccgatttacatcagttaagcattgacctcgccaacctcaactggggctggtttagcgtggccgtcttatgtatttgcctttacctggggctggaaggggtcgttaccaagctcttcatggccgaccgttacccggactttagctggaaaaacaccatgcgggtgccgctggtcgaacaactcttcaacgggattactcccttttccaccgggggccaacccgcccaactagtggcgatgctccaggctggggtcgatggcggccgggccagctcggtcctcttgatgaagttcgtcgtctttcaggggatgatcgtaattaacttcattatcagcatgctgattggctttcactacattgccaccaagctccaggccctgtccttgctggtggtctttggctttgtcattcacctgagcgtgatcgtcgccttgctcttagtcatgtactggcactcctttaccaagcgggccaccaacctcttattaaggccggtgcgttggtttgttaaagagaaccgttaccagaactggcagcgggtcttagacgagcggattgactccttttaccaggagagcttgaagatgcgtcaggagtacggcaagctcgctaaggtctcggtggtgaccttagtccagttggccttttactacctaattccctacttcattctcttggcgctgggggtgcaaaaccttaacgtggtgatgatcgtttccttaaacgtcttgatctttatgattacctcgctcttcccgattcccggggggactgggggggccgagtattcctttaccgtcctctttgccagcttcattacctccaacgctaagctagtcttggccatgctcttgtggcggattctcacctactacttcggcatgtttgccgggatggtggccctcgtcttaaagcccgatccggtgaagccctatgaatgattaactgagcggcgccgttaagtagccgttgaaaagtaaggggaaccgtctccccttagtaaaacagattaacttagacccccatagtcgctggccggctgtgggggtcttatttatatcggccctttgtcaaatcctgttgatgagattgttttaggcggcgccaggtgctagcacctggcgccaacgccttggggaaagcgagctaagttcggcgcccttagctggttaattaaccggggtaaggtagtggtttaggctagcgctaccgccccgttttgcctttaagtagttagaagggtaaaatagataagataacaaggagggaagacaatggttaattcgaatctacgtcggatcatcaaacgcttggaggcgatggtggtggacggggcggggcccttgcaggttcggaccttcgaacggtatgggattgcggtgtgcgacgtcctcttcaatcaggagagcggggagtttgtcgttaagcgaattgaaccaggtgacgtgatggtgttcgatcaactcgacttggcggccattgaggtctatgactgtctagaatattttcgccaacgtttttaacttttttgccaaaaagcgttgacgatttaaaaagtcactggtatagtatttaatcgttgtgataagcaaggacgacatgaagttaaccttgtaaaatccttcaaaaaacagtgttgacagttaattgtctgatatgatatattgattaagctgttaaatcagcggtgccaatgagttaaaaaagaatttaaaaatatcttgacaacacattagcacttatgataaaatatttaagccggctggctaagctggttggccatttctggagtggttccactagccttagcgacttggttaaagacacggtcctgagaccgcctctcacaaattaccatacacaaacattttagcatgaaacaccccccgccccctgaccgctacaaaaaagagcgcacacattgcaatcgtcttgcacaaaaaccaaatttgaaaactttttgccccagggggctatatatcatatattatctatcaaataatatgtaacacttacagtgccaacggatatagcgataatttactttaacaaaccagtgtcaataacactcaattgatgccctttttagaggggggcggactgcgctacatgtatcctatccctgtgctagtgattttttgagtcctactcccacaagggatacaggcaacgattttctctaatatacttaagtgaggtgcgcaatgcctttaaaggattgcgcccttgctatactacacatgaaacacctgagtacttccttactgggatataaaaaacagaactaataatctacgggctcaattttgagccggttgttaaattaaggacgggggaattatgtttggcagccaagaacaacacaactaatcaactaaggggaatgattacccaatacctgaatattctgggccttcctattaaggcaacctcggaaaacgttgcccaccgttggcgctattggacggacggcccagcacttgttaacgcctttgaaaacttagcggcggttgtggtcgacttggtaaacaaacaggtagtaccgaacgctttagatgccccagaactcgaatttttggtggtgtacacggatcgaaaattcacttttgtgcccgctcagtgaatttaaggacctaaagacgcagcttaaactcttaattccccagttagagcaaccgccaagatttttggcttagttgccgccttcggggatggtgagcactgcttatgtttgcaccactgtctttgcaaaagcgggtgccgctcaaaaggcccgtctgttaaagggcgaggataaactaggttaaccgcaataacaattaagaggggtgttcctactcaaccgagtaggggcgccctttttagatgccgaactttaaaaattgggcctttttttctgcccgaaccatcaaaccggacgttcggcaacgaagcggagggcgacacagtgaaatcgtttccgaattgaccaacgtaattgagtggttaggaaggggcgaatgttcgcttccgtcgttaacgaaaatacgcgaacattaaagtcgtttgttaaaatatagttaataaatcaaggcattgaggggttgaaaatgatttaatcgtacgttattatacaatcacgttcgaacgagataagagagttgcacaatggcaaaaagaggagaaagagaacgatgaagtttgatagcgttgaaactgcgttgacccacttgaagaatggcggctacatcattgtttccgataacgaagaccgcgaaaacgaaggggacctggtggccctagctgaccggatcaccccggcgacggtttacgagatgctggaagaggccaagggcttgatgtgtgtacccctgaccaaggaacgggcggaccaactgggcttcaccaagatggtggctcacagcaccgacccgaacgaaacgcccttcatgacgaccgtggatggggccttcgaagcaaccggcgtcacgaccggggtgtccgcctttgaccgggcggccaccattaaccacatcgctaacgatgctgccaagccaaccgactttaaccacccgggtcacatccaaccgctgtactcccaagacggcggcctacgtaagcggatcggccacaccgaagcctccgttgacctcgccttcttggccggggccaagccggtagcggtgatcattgaagtgctgaagagcgatggtcacatggcccggcgcgacgacctcttccagttcgccgaccgcttaaacgttccctacatcacgatccaagaaattttaaactacatggatcaacacgggattaaggaagcgcgcgacctaacggagccggtacaagcctaattatcagggtgtgggaaagtttcccacgccttttttgattaaaggcggggcgccgctctgttaatcaaaaggggtacaatggtggtaagagggaggagttacggatgattgtgtggacgaaccaaccatattcggtttacgagcaactgatggcaacggggagctttagctgtacaccggccttatctagtatggccaagcagaaagccggaggtctggcaccgctaatccacactgatcgcggagcagcatatacttccaaagcattcaaccactacttggctattaataacagccaacatagttactcagccccaggaacaccagctgataatgcggtgatggagcactgatgggctgattttaaatctatctggttagcacactcaccacaaccacaaacgtttgaagacttagaacagctggtgacagaaggtatcgattactttacgcattcctttatttcaggcaaaagaaatgaccttaccgcagcagaataccgcttcggcaaggccaactagtttttattatttaatgtgtcaacttgacagggtacagtaccttaaattttacaatctatctttagtattcgccccaatatttagacattgtttgtttaccaacgccagggttgaaactattagttggatcatttttcttatagtgcttgattaaggccggtgctgccaaatatagatgcccaacattgtgttcggctggataaacagcgtgacgctcatccaaaattttaagcatttcttttttaagttcatgcgcatcgacgccaggttttagaatataatcctggtgcataacgtgatcaagtaagtgaccataataaattttgtgttctattttgtcttcaatctctttaggcaaatgctcgaaccacttataatcattacttgccaacgcgatatctagtggcaaaatgtcaatactatcctgttttaattcttgatatcgaatcgcaaccccagctgttacatagcggtgagttgccgctttactggtctcattggcatcggcttcaaagtagtcgccactggctttgtcaaaataagatttgagatactctcgcgcttcttcaataccattaccagccattttcaattgtaggtaatggtcgtacttttcgtaataatcatctaaccgctttggcatttgattaggaaataaattacttaatgtttgaagcaaacgatctgggaaataaggtttgaaaaacggaatgtgcttcaaaaagcgttcgccccatgcttttagcgcaaacatttggggcaaatgacccgtaccaattttttcaatcacaattagtgagtctttaccatatttcttggccaatttataagcatttttatgcatatattcaccagaaacaggcaattctttgaatgtcgtcataatatggcgacgaatatcttccaactcatcgggattattcgttccaatgtaaaacatttgtgtttttttatccattgggaatgtatctaagcggacagccaatgccgcaacgtgaccggacgatccagatacttcatacaattctttaggatttgcattgtatcgaataggcttatcagattcaacgtcacgcaaaacctgttcatgatggaacattgaagcatgatgttcagtaggtggtacttgattcaaatcaaaattgcggttctgcaaattagtaataatctcttcgggcgttttgcccaaatcaatgcctaaatggttaactaagtgcatttcgtcatgttcatcaatccaaacatacaatgatagctctgtataagctggacctcttctgatcaaagcaccaccagaattgttgttaataccaccaatgaccgatgcacccaaattagatgagccaatgactgaatgtggttcacgtttaagtggtcgcaattcattttctaagtgaaacagtgtcgtaccggggaatgctagtacttgttccccattattgattaactgtaaatctttaattttcatgccgttcacaacaactgcagaacggtcataacctggggctggtacggatccctcagtcaaactagtgttggctgcttgcataataatgataatattgttatcatgcaaaacattaagcacacgccacattgccattaaagtggttggaaatacgactgcaactgcatcgcccttacctgagcggtaccctttcctaaaacgtaaagattttgctttgttagtaataacattttttttaccaacaacattgactagttcttcgactaagtccatattaacttctcccctctataacgtttgtaaaaaacgttttaatcattacgctttcaatgatacgctttttttgaaagcgggcaaggaaacacgttcttttaaggacgtgatgaattgccttttttttgatgcgtatctgtctcaaatattgctcctatgtcaataaatggcacatctttttctaaacactcgttctaattctgtcggaattaaaccaactgatgtaatttgaggttcggattaccaagtcctcaaaatcggaaaaagttgtttgaaaggcaaactctctcttcaacaatgagtgaaaagcttcaattggcccattatcataaggataaccttgttttgagtatgagtggctaatctgatgccgttcaagtaaagtttcaacttcgttgctggtgtactgtgaacccatgtcagagtgaaaatattgtggcttttgatgacattcaagcgcctgattaatcgtttctacaactaacgtcgcctccatctgacgaccaatcttgaaagcaaggacttgatgaacctttggttcgtaaatagaactgagataaacccaggttcctggacgtaattccaaataagtaatgtcagcacgccatatccttgcattgggctggtgcttgattaaattggggcgttgtgaatgatccacatgagtgccaggttttttaaatcgccgattcattaaagagtgaatctccatttccctcattaatcgtaaaattcgttttgacccaacacagatgcctgacttgcgaagcaccatcgttattcgtggataaccataggcacgataattattttcccaaatcaatttaattttttctttgagctgattatcaacacgttcgtgttgactaggctgatatcttttccaatggtaataggtgctgcgcggtaatttcagtgccgaaagaataattgataagcggtgtcgcaataactgatcttctatgaagacaaggcaattaattcgtcctaatgctttcccagtaacaccgccgcaacttttaaaatttcaagttcctcttttaatcgctaattttccttttgaagttgtttgaattctttggacgttacttcagtaccgtcttctagctcaactgatttagcgcctttaacccagttatgaattgcggctggggaaacaccgtattcctcggaaagcgagcgaatagatcttttcttttcacgatgcatcttcacaatgctggctttaaaatcatcttgatatcgtttcattggaatgctcctatcttgttttattaattatggcacaactgttcagaaatttatgtaccaaatactaggataggagcaatttgattgaagaacaggccggtgttccgctgtactttacgcacgcttattcgccacatgaacgaggtagtaatgaaaatcgcaaccgagtactacgccgcttcattcccaaaggtcaaccaattgatgagattaccgatgatgaattgattcaaattaactggtattagaattcccgaccactcaaatgtttaaattggcgaacaccgattgagatctttttacgtaatctgcgttactaaatttgttcaagttatttcttgcaatctgccaaaagtaaaaaaagaggctggcaattgccagtccctgaggttggggagcacttcctaattcttaaattccaaatggtggtgcaagttcttgaagacgtggcgatcagcccagccaatcaggtaaccctgggtggcgatgttgtaaaaggtcccaaagttaaaggcgaataattggccggtaaagagccaggagaacaagacgatcaacagcggcggaacgttggaggcccactgggaccaaactggtgacccgtgcataaagcggaagcgcaggatgtagggaaggtcgtcgttggggtgcatgatcaagttggcccgctggtagattgaaacggcctcggcgaccccaaagaggccaacgacgtctaagattagccgccaccacagggggagggtgccaacccccagggaaatgaagaagtgttcaaagccggctagtaaataggaaaagggggtgatgtaaaggaggttgcgaatcaaacggaagtagtcaaaacgccccagtaaaaagaggttggccacggcgaccacgatcccctccaaaaaaagggcgttccctaaggagaggtggacccagtggctcaagttaacggccgaggcggtccagatcgccgaccccatgttggtggaaacggtcagggcgttagaaaaggcgtttaagaagatggaaacgaataagaagaaaaagcgcccggacagggtatcggcgcgggtagtggttatcatggtgtaattcctttcatggcaaatcgatcatgttttatgatacaacttctagggaaattttaaagattgattgtgaaagttcggcttttaaaatcggggcgccgctgttttaaccggtaaagcccgtcaagttagtaaatcacgaaatttgtttatcacctaatttgcggaaaaaccgaaagaaatcctggaattgtgataaaataatgagagtgacttttaagagatatgagatggaggattctttatgaagaagtaccgctttttccgcctgagtctcgggtggcaaatcgtgatcggactcgtcctggggattgtgtgtggggcctttacctaccataaccagggcgccattacgatcatgagtaacctagggacgattttcctacggttaattcaaatgattgttttaccaatcgtggtctcctgcctgacggttgggattgccaacatcggggacctacacaagcttggtcggattggtggtaagaccatcatttactttgaggtcttaaccacgatcgccattgtcttagggttggtagttggtaaccttgcccaccctgggacctttattaacatccatgacctacaaggaagtgatatttccaagtacatgacgaccgctaagtcggcctcccataccgggatttgggatacaattttagccattattccaacgaacatctttaagtccctagccgatggggaaatgatgcccgtgatctttttctccgtcttcttcggtctggggatcgccgcgattggggaacggggtaaggtcttagtggacgtcttaaacggcgtttccgaagttatgttcaaggtcaccaactgggtgatgaagttcgccccaattggggtttttggcctgatcggaatgacggttgcccaaatggggttgtccgccctcctgccactgggctacttcatcctgattgcctacgtaacaatggctatcttttgtgtcgtggtcctcgggatcgtggctaagatgttccacctgcactattggaagacgatgcgggcggtctttgaagaaatcatgctggccttttcgaccgccagctccgaggcgaccctgccgcggctgatggaaaagacccaaaagatgggggtcgacaaggggattgcctcctttgtcatcccgactggttacacctttaacctcgacgggtcggcgatttaccaatccttagccgccctcttcttggcccaggcgtacggcttacacctgacctgggagcaccagtttaccctgctggtggtcttgatgatcacctccaaggggatggccggggtaccgggggcctccttcgtggtcctcttagcctcggtttctacgatcggggtgccggtagccggcttaacctttatcgccgggattgaccggtttgttgacatgggccggaccgccgtcaacgtggtcgggaacaccgttgccacgttggtaattggtgaatctgaaaagtcgctagaccaagacaagtaccaccactacttagataactacaaaaaagaagatttaaaggaagcataatcatgaccaacacccgtttactggcgcgcgatgaggttcccaccgaattaacctgggacttgacgcttttgtacccatccgatgacgccatgcgggcggaccttgatgacaccttactgctggccgacaagctctccgggtttgccggccatcttaatggggccaaggagctgctcgctgcattaaacactcacaagcaaatcgaaaccgacctggaaaaagaatacgtctacgccttcttacgccgggacagtgacaccaccgatgcaaccgccaacgccctgtttgggacggcagccaaggcggccacgacgatcgccaccaaggaagcctttttggaaccggaaattttagcgattgacgaaggggcgctggacggttatttcaagcaggaaccaggactcgaagaattccgctacgagttagaacagatccgcctgcaaaggggccacgtactgacgacgagcgaagagaagcttttgtcgcggctcaaccggtcgttggatagtgccgatgaaatctacaacaccttaaacgacgccgacctcaactttggccaggttcacgacgatgagggtaacctggtccaactgacccacggtaaccgtagccagttcaccgagtccttgaaacggccggtcagaaaagaggccaccttggcctacgccaagccttaccacgacctacgcaacacctttgcccagaccctcaactcctttgtcggggcccaaaatgcggtcgccgaactgcgccactaccaattggggcgccaggccgccttggccccgcaccagattgacgagcaagtgtacgacaccctggtgaaaacggtcaatgaccacctggatttggcccaccgctggtaccggattaaaaaggattacctggggttgaccgactttaaccaggccgatatcaacaccccgctggccggcgatgacgtgttgaagacgacctttgcggagggcaagcagctgaccttagacgccctgagcgtgctgggtgatgagtacacggccgggctgaaagaggagtttgaccaccgctggattgacgccgccgaaaacgccggtaagcgctcagggggttaccaaatcagcgtttacaaggccaaccctttcatcttgctaaactggaccgataagctgtattcgacctacgtcttggctcacgagtccggccacgccatgcactcctggtttagccagcaccaccagccggcccagtacgccgacgccccgatcttcttagccgaggtggcttcgacctttaacgagcagatcctgaccagctacctgctggaaaagtaccaagctgataaaaaggtgcaactttacgtcttagaacaagcgatcgatggctttattggcacgatctatcggcagacccagtttgccgagtttgagcacaccgcctaccaaaccgaacaggcggggcaggcgttaacggccgactttttggaccaaaccagcagcgccctgctgaagaagtattacgggccggacgtggccctgttagacggcacggcgacccagtcttgggcctacgtcccgcacttttacatgaattactacgtctaccagtacgccacctcctgggcggcctcgaccagcttagctagcgccgtttggcaacacaagccgggggccaaggaagcctacctgaacttcctttctgctgggggctcggcggcgccgctcgaaatcctcaagcgagccggtgtggacgccaccaccagccaatacctagaggaagccttggcggtctttgaacggtacctagatagaattgaagtgctacttaagaactaaacagtaagcccagccgtgcggaatcccgcgtgactgggcttttatagtgcctttaacaatccggcttgccaaggaggttgggtcgcacttccaaagataacgtgctcccaaccacgggcctagtgcctaagtacgggtaaagaacggtgcgtgccacaccaaccgttcgccctagcttagccatacggtctgttgagaaggtcatttcccacttccaagataacgtgctccccaaccgcaagcctagtggttggtccgcactcacttttagctatagcgactttcgaaccataatctgggaatcgaccagggtcgtagccgggacctcctggtggtcgagcagggcgaggaggttttttgcggcgacttgacctagttgttgcgggtcctgttggatggtggtgatctgtggcgacatcagtttggcccagtcccagtcgtcaaaggccatcacgccgacctccttggggatctggacgttaaactcggccagggtctccattaagcgggttaacaaggtgcccttaaaggcgtaaataacggtgcgcccgttcaaccagtccggtacctgagctagcttagcgtaaatgctgccggtcggctcatcgtgggtgatttcgacttggtggaccgttaaatcgtgctctttggcggccgcttgcaccccggccaaccgttccagccgggccgaattggcgttgatcgcctcgcttaaaacgactacctgctgaaacccttggcgcgcggcgtagtcaaccaggagcttagagtagccctggttgtcggtgatgacttgggaccacttagcgggggtgactttacggtcgacgatgatcgttggtacctgggcgtctgctaagagctggtaggtgtcggcattcatcaggctgggctggaggatcaccccgtcgacccggagtttaatcaagcgttctaattgccggcgctcgagcgtggcggagttgttggcgttcatcagcatgattgagtaatcggtggccgctagtacctggtcggcccccttaaagagtagggaggaaaagatgttttcgatgtcggctaccaccatcccgatcaggtggctttgccggtgggagagggcctgggcctgcgaattggcttggtagcccgcctcttcgatgatctgtgcaattttttgccgggtttgctcagacatgcgctcaaagtgcccgtttaagtagcgcgaaacggtggtcttggaaaccccggcggcgtgggcaatgtcattaatggttgtgtattgtttggccaatctggtcacctgcttactaacgcagtaggtagccaccgtcaaccgggatcgtcaccccggtgacgtagttagaagctgcgctggccaagaagacaacggtgcccattagttcagccggttcggcccagtgtccggccgggatgtgtcccaagatttccttgcttctaaccgggtcttcttgtagcgctttggtcatcggggtgttgatgtaacccggcgccagggcgttgacctggatgttgtcagcggccaatgcgtcggcgtaagccttggttaaaccgacaacgccgtgcttgctagcggtgtaagggaagatgaacttgccggcccggtaggattgcatcgaaccaatgttgatgatcttaccgccgtcctgtcgtttcattaccttggccacttcttgggaaaggtagtaaaccgaattgaggtttaaatcgagcaccttttgccagtcttccttggggaattcatcccaggggtggcgaatttggcggccggcgttgttgactaagatgtcgatgcggccgtattggtccaaggtggcgttaacaatcttttgcggggcgtcttctgcggtgacgttttgggcgaagaaggcgacctggccaccaagctctgcggcgacggccttaatcttgtcccagtcccgctcggagtggctaaccaccatcaccttagcgccgaccgtcagcatggcccgggtgtagtattcacctagccccgagaccccgccggtgatgatggcgaccttgtcagttaacttgaagctgttgatgttgaacatgaaacgacactcccttttagtttaccggtttcctgaaaaattaacgcttaaagtttgatccaatcggtgtaaagaagtcaactattatttaattttgggttaccggtaacctaaacagctaaaaaaatcccccacctgggtaagggtgggggatgtgcttagtcttccttgtcttcagtggcgaggtgtaatccacggtgctcaacactggtggagaaaacgatttgggtactggtcttgccaaagcggctttggatgtcgttgatgaattcatctaaagcggcggtggtttcaaagaccacttccatcacttcggagtagtcaccggtgacgcagttacattcaaccacgttgggaatcgagtccacgtacgggtagaattcctttttttggctgggttcgagttgaacctgaatgaaggccttgacgtggtaattgagcttttccaggttcaccgtggtgtggtagccggtgatgataccggccttttccagcttgttaatccgggcggcgatggcgggggaagaaataaagcaggccgccgaaagttcctttaaggagacccgggcgtttttttgcagcatgttgatgattttttgatcgatggtatccataagtgagcgtcccttcatatgaaccaataacgtttgtgagaattttaggcgttttggattcaaaagtcaattttgttgcagttccgagtgatcccgccttttgaaagccttttatcaatggtataatgagtgaaagagttgagtgaatggaggttacttctatgagtcaagaatacgaaaacatcctggttccggttgacggatccaagcaagcagaactggccttcaacaaggcggtggcaacggccaaacgtaacggcgcccaccttgatttactaaacgtggtcgacacccgggcgatgtcttacaacttcgccggcatgtctgacggaagcattgcctaccaattggttgacaagtccaaggagtacttagatgaactgctggaacgggccaagaatgaagaaggctttgacaacatcgacattcacatccggttggggaaccctaagacggtggtttcctttgatttcccacgcgaccaccacaatgacttgatcatgatgggggcgagtggcctttcccgggttcaacgggcgatggttggctcagtgacctcctttgtaaagcggaacgcccaagtggatgtgctggtggtgcggaccgacgttaacaataagttgccggaaaagtaaaaaaagaagtgcgaaccaactcgtcggcaggccgtatgactaagctaggacgaacggttgatgcggtacgcatcgttcttcggcctgcttaggcactaggcctggggttggtgagcacgttatctgtgtaacagcaaaaagaggttggaaaataagtccagcctctttttttcgcggcgaatttacaattgaaatgcaacacaaagtaaaaaaagaacctcccgcaggaggctcttgaactgagtaaacagtttttattgttcttcgtaccaggagtagtggaagttccccggacggtcggtacgttcgtaagtgtgggcaccgaagtagtcgcgttgtgcttgcaagaggttagcaggcagaacttctgcacggtaggagtcgtagtagttgatggctgcggcgagggaaggaaccggaatcccagccttaacggagagggcaaccacttcacgaatggccttttggtacttcttagcaatgtccttgaagtagtcgtcaagaagcaagttcttgagggccgggttcttttcaaaggcatcagtaatcttttgaaggaattgggcacggatgatgcaaccttcacgccagatttgagctaattcaccgtattgcaggttccagtcgtagcgttcggagtcgatccgcatttgttcgaacccttgggcgtaagacatcaccttaccgaagtaaagggcttggcgaaccttttcgatgtattccttcttttcgtcgtcggaaagggtaaccttttcaacgtcttcaggaagttccttgcttgcggcaacccgttcgtccttcagcatggagatgtaacgagcgtaaacggcttccgtgatcacggattgtggtgcaccaccatcgagggcggtttcagaagaccacttaccagtacccttgttagcaccacggtccaagatagcgtcaacaattggtaagttcttgtcgtcacctaagtcgtccttacgggtcagaatatcagcagtgatttcaacgaggtaggaatcaagttcacccttgttccattcggcgaagatgtcagccatttcatcaacggaaaggccaagaacgttacgcataacgttgtagctttcgtcgattaattcttcgtccccgtattcgatcccgttgtggaccatctttacgtagtgacctgcaccgttcggaccgatgtaggaaacacatggcttgccgtcttcagccttagcggcgatttgggtcaggattggggcaaccaggtcgtaagcttccttttgaccacctggcattagggaaggaccttggagggcacccaattcaccaccggaaacacccattccgatgaagttgatcccagattcgtccagcttagcgttgcgggccatggtgtcgtggaagttagtgttcccaccgtcgattaagacatcacccttgtccagcagcggaagcagttcgttgataacagcgtcagtacccttaccggcttgaaccatcatcaggattcgacgaggcttttccagggagttaacgaagtcttcaatcgtgtatgaaggaacgagcttcttttcgctgtggtcgcgcatcatttcgtcagtccgttcacggtgacggttgtataccccaaccgtgaaaccgcgactttcaatgttcagcgccaggttcttacccatgacggcaagaccgattacaccaatttgtgccgtttgatcagccattgtgttgtcacactccttaaataaacaattacttacatacaagtgacattataacagattgaaccgggtggggaaatacctttgcgtaactttgaacaaggccgtgatggcgcccatgccggtcctttttaggtgattagtcagctaccaatttttaccaaaagcgctaccatcaccgtaaggtctagtggtttaagttgtagacccatgcccggccatcgcgagccagtagttcatcagaagcggctgggcccatcgtacctggcgtgtagttcgggaattgaggttcttcaatgtcccagagcttacgaacgacgtcaacgaacttccatgcgtaggcaatttcagaccaggacgcgaagttggtgtggttaccttctaaggcgtcgtggaagagacgttcgtacggttctggagcttccttcttgctggagtcgttttgcatgtactccaggtcaaccggttcagtttggaaaccttggccagccgtcttggcgttaacccgcaaggcaaaaccagattgcggttcaacgtagatggtcaagacgttgctcttcagggattgttcagaagccatccgtgggttagcgaagatgtcgattaacggcttacggaagaccacgtcgatgcgggtgaacttgtcagccagcttcttcccggtccgcacgtagaacggcaccccggaccagcggtagttgtcaaacatcagcttggcagccacgaaggtttcggtgttggattgtgggtcaaccccgtcttcatgacggtagtctgggttgtcagcgccggcgtcgtattggccacgtacgaagttagaagcggcttctgacggtgtgtacaagcgcagggaacgcagggccttgatcttttcaacccggacgtcggagtcggtgaaggcaacgggttgttccatcgctaattgggcaacgacttgcattatgtggttttgcaccatgtcacgcaaagcaccggagtggtcgtagtaaccggcccgttcttcaaccccgagcttttcggacagggttacctggatgttgtcgatgtaacggttgttccaaagggattcaatgatcgtgttcccaaagcgcagggcttcgatgttttggatcatttccttacccaggtagtggtcaatccggaagatttggtcttccttaaacgtttgggaaagttcatcgtttaaggccttggcagacgcaaagtcgcgaccaaatggcttttcgatgaccagacggttgaacccatcgtcagtcagcagggcttgcttctttaagttcaaagcgatcgtcccgaagaattgtggggccatcgacatgtagaagaggcggttgccttccgtttcgaattgttcgtccaacttttcaagccgttcctttaacacttcgtagtgttccggcttagtgacgtcgtgggattggtagaagaagtgcttagcaaacgcttgggcgttaccagcttgcacttcgtcaatgccagagatcgacttttccaccattacttggaattcttcgtcggaaaccggccgacgggacgtcccgagcagggcaaagtgttccgcaaggtaacccttttgatacaggttaaacaaagatgggtagagcttgcgttgggccaagtcaccggtggccccgaataatgtgatgatagctttattttccttagccaaaatgttcactcctctaagaatgatcaaagaatacaaccttaacgaactaattatatactttctggaaattgattgcacgggcgcccagtagtggtggtgccgctttcgtgaaatggatcaccaaccttgttagcggcgaacagcctactaaccggttttcgtgttaattggtctagattgaaataaatttttcaaactcttagtaaccgcccggccacagaacaccgctggcgcgctaacccgtggtcatttcccataacgtgctcctaaccacggacctagtgtctaagtacggctgaagaacgatgcgtgtcgcatcaaccctcgtccgatccttagtccacggcttgccaatggttaggtcgtacttcctaattcacgtactgattgcgttcactcagggttccaaagagggtgaacaagcagatcacaatcagggtgacgatgatcgggccgtgccaagaaccggaagcggccttgaggttcccggtcacggtcggaccaaaggcggccagtagataacccagcgattgaaccattccggacaggttccgggtgtcaccagccgtgcgggtctttaagcccaacagggtcatgattaaggagaaggtggctgccgtccctaacccaagtaagagggcgattaggacgtagtaccagaactggtggatgggaagtaacatcgccaaaaagcccagtgccgttgagatcccggccgccaggactaggggaatccggttgctcatccgagtggctaacaccggggtggcaaaggcagtggggatcgagaagagctggaagatcccggcaatcaggctagcggtgttggtggtcatcccgttagccatcgcaattgacggtagccaggcaacgatcgtgtaaaagacgaaggaggaaccggcaaagtagaacaataagaaccaggcccgtgggttcttccacatgttggcgccggtttctttggtatccgtcccagatgttcggtagttaaagcgtaggttaggcaaccacaccagggcggtgaagaggactaacccggacaataagacgatggcaaattgccaactggaggcggcgctgatcggggcgatcgcgtaggccccgacggctgaaaagagggtcatcgccacgttataggtcccggtgaccgggccaatcttcgttggtaggttctcggtgatgacggccggaattaagacgttaatgaaggtggtcgccaccccgatgattaaggtcccggtcaaaagggcgctgaagccaaagatccgcaggtaagaaccggcggctaacaacaatagggcgatgaaaagggccagttcgttccctaaacggcgggcaatcccgggcaccagggtggaacaaaggccaaagcaaattagggggatggtagttaagatccccagcgaggtggccggggtgtggaagctagcggcgatttcgttgatcaccgaagggattgaggtgaatggggtgcgcatgctagccccgagcaagaagatcccgatgatcaaaaaggcgctgtgctgacgagtagttttcatgaagggcgttcctttctttaatgatttcgtaaaaattaagctagtctagtataacatggtttacaaaatgttaaaccgttttacgtcccggttaatcaatgttaattcggtttcatggggtggggcagtttgacgaatggcccgatcgcccctataattttatttgatactgtaaaaaaacggaggaacataatggcagacatatacccctacttggtctttgaaaacgccaaggaggccatggcctactacgctgagcagttcgatgctgacatagtggcgcggcgccccttaactaaggctcaggtagatagctacggtctggaactaacggacttagacgaaacaactgcctacggtgaatttacgatcgctgggcagaccttcatctgtgctgacgccatgatggcaatgccccagacgtcttcgttggtttcgatcctgctcgattttgccgatgataacgttgcggcggccgactttttgaccacttggccgcttccgatgatcagcgcgtaacgttaccctttagcccccaaccagcggggggccaggcgggtcagattgtggaccgctatggcattacctggctgatttcggctgggtttgtaaagcatgaataaagaagtgagtgttcccaaccccctctttagacttcaattaaataaaatcccgaaccggatcaatcgagtgttgattgatccggctcgggatttttcattcggggattctttttaactattatacagataacgtgctccccaaccgcaggcctagtgcctaagtacgggcaaagaacgccgccagggcggcaacccttgccctagcttagtcatacggcctgccaagcaggttggtgagcacttcttagccttgtttctccgccacatcctttaggcgccggtagaccacttccaagtcttcgttggtgccgcgcagttcataatcggctacgaacggggcgtcaaaggccttggcgtacatccgggcggtcaggcagtattgctcgttgaagtttttgttgccgctaccgaccacgccgatcaagttgtcggcgttcttgccctcggcgatgtattcacccagcgggttggtcatcatttcggtataaccagaggtaaagccgtcgcccccatccaggtaggtgggcacgaaggcgaagaagggctcttcttcgtgggccgggatcgtttgggcggtgatttccttgaggttgatggtcggattagcggggttgatgctgttcatttggttagcgtaggtttgcagccgctttaaaaaggagcgggtgttcccctcgatggaaatgtataagacgttaatggttgtcatgcgacaaggcctcctgattattctataaattctattttacctggggaaggggggatttaaaagggcgactttggtgacctagcgcgctaagaagcggcagaaccggggttgggtgactccggcgagtccggttctttttccaggcgttgaactacaaagcgatcaatgtatgagttttggtagtcggccaccgttaactgaaagtcgcctagttcaatcgtctggccctcgtgaacgtggggaaccgtgtccattacaaacccggctaaggtaacggcgttggagtggtcaaaggccttgatgtcggtgtggaagtagcgttcaaaatcgtaggtggtcgttttgccatcgacttggtattgaccgtgttcacccttttggatcaggttatcggcgacgttatcaatttcatcgcggacggtcccgaagagctcttcgtaaatgtccttgtcggtgatgatcccggcggtaccgccgtattcgtccatcaccaccaccatcggtacccgggtccggatcatcatttgcaagacctcggtgatcggggtggcttccggtgttgttgacaggtggcgtaagattttggctaaggaaacggtggggtcgacacgctgttggcggatcaagtcgtagttaaagacgtagcccaagatcttatccttatcaccgtcggccacgaccggcaggcgcgagtacttggaggtgatgtacaggtcgagggcgtcgccaacgctttgtgtgatgtcaatgacggttagttgggtccggtcaatcatgatgtctttggcgaccttgtcgttgaagtcaaaggcccgttccatgtagaccaagtcgttgcgccctaattgcccgccgcggacggcattgcgtgacaaggagatgatttcactttgcgacagcacctcgtcggcttcgttggccggtttcatcccaaccaggcggacaagcccgttggccgaggtgttaagcaaccacacgaaggggtaaaatagaaggtggaagtagtgcaagggggtgacggtgaagagtagcatcttaaccgggatgtcgatcgagatgtttttcggtacaatctcggttaagacgacttcaaagtaggttaacaagaggaccccgatgacggcggcaattgcgtgggcaccggtggtcgacagggctagggcggggaggttcaaaaagttgatcaggagttcttcgatcgtttgctccccgatccaaccgaggatgatcccgcacaccgaggtcccaacctgggtggtcgataggtactcggttaagttagaaaccatcgtgagcgcccgttcgatcttgaggctctttttaccccggcgctcctcgaagttttcttgggcctcttctagggcggtaatccgggtttgcaccagggcaaactcggcggccacgaagaaggcggcgaaaataaaggtgattaaaataatgctgatgttagtcataatttgctggctgtccaaaataacgaatccctcgctttaaaatggtgcgcttattcggcggtctggtaaagttagtactaattattataacattgataaccagttccgaacggcaagttggtcctgtccccgttaccggccagtttgcggtacaataaaaggaaaaatggtgattaaaatgcaagtacggataattggtggggagaagttagttgcccccgtggcccaagccttaaccgagcaagggacggcggtcaccacgacggcagacttttccggtaccctggccccggagacgaccttggtatggttgccgaaccccttggacccggttggtgacttggtggcggacctggtggccttagtcgatcggtcgccggcgccgaagcggatcgtgatgcacggggtccccggcaccgcggatgacgcgagcccagaacaggtcggcgcctggtttcaaacggcggggacgtcattagtaatggagcacttgtacgccgtcaagatgattgatgaactagagcacccttacgtaatcgtgcgaacgcccccggttaccgggcggggcggcaacgtcaagggtgagggtgaaccgattcaacaagcaacggttggccaagaagaaaccgtcgccctcatcaccaccgccgttaccaccgaacagtacgtcaaccagtcagtgggactgggttaggaggcagagatgacagcaacacaattagaacacttcgccacccaggttagtaaggttcaacttccccactgggcggactttccggagatgggcctgtacgccgaccaggtaatcggcctggttaacgaccgcctgcgcccgctcggcgttcccccgttgaccaaggcgatgattaacaactacgtcaaaaaggggatcgtgatcgccccggtcaaaaagaagtattcccaaaaccagttggccgccgtgaccgtaatttcgttattaaagggttcctttgccctgccgacgatccgggcggcgattgaccaggtgaccgtcaataactacccgatggccgcctacgaccgcttcgttgacctcttcaatgccgccttacgcaacgaggaggccaacaaaaccaccttggatccggcgattgaagaactgctaaacctagcggtggtcacgacgattgcgcgcttgaagactaccgccttgttggccgttttacaagaacagctgccgccgactaagattaagtagggaagtgggaaatgaccttctcgacaggccgtatagctaagctagggcgaacggttggtgcgtcagcaccgttcttcgcccgtacttagatactaggtctgtggtcattttccacgttaaggggagtgcggaccaaccttctcgacagaccgtttggctaagctagggcgggggttggtgaggcacaatatttgtttaacattcgaagataaagtaataggctggaagaaaaacgccccttcttccagcctatttttagtttgcgttagccgatcaagcccgttaggtaacggtgactagccaactgttcttggcagtcggtttggtcggctaagttgatctcgtaaatgttggtggcccgtgggtttaacaggggccagacgcgcgaccagtcaatcttaccagtgccaagcggcagggagtcgtgactttggcccatcgagtccaccaagtggtagtggacgacctggtccttgagcttagccagggaggcgcacaaggcgtcgttatcgccgtgcaggtagataaagcagtgtgaggtgtcaaaggccaagcggtagccgtggtctaagatggcccgttcggtgaccgggttaccataggcgaaaaattccgaaatcgaattttcaaacatgatgtgcgtaccacctagttcttggaaccgatccagccggtttagcaccgctgcttgggccgcttctaagctctgataaaaggggatcacccgcgggaaatcgcccgagtaaccaccgtggattaggatttgaaggtcaaattcgctggccaactccaggagggtagcggtggagcgttcgataaagtcgtacaggtcggggaaggcggtttgtggcgccgccaattcgctgtggatgtcaccgaacttcatcggttggtggatgacgatttggtcaattccggcgccctgcacactccggatgccggcctttaactcggccaggccggcgggggtgaagttgtgaacgtcggtgaagaactcaaaggtttgcgggtggtactttaggcgatcctcaatttgggccggatcgctggaggcctttaaccctagttggggaaacattgttaaaacctcttttctaaaagggaccgggaaaagatgcccttccccaatcccttatctaattacatacttagtgtgggcgcctatttcagtcagtggcctgcccaatggttgggcccataataacgtgcttccaaccacgggcctagtatctaagtacgggcgaagaacggtactggcgcaccaaccctcgccctagcttagctatacggcccgtcgaggaggttggtcgcactcacagatttttatccatcgtaaaggtcagcttggataactcgagccccttcatcatcagcttagccatcaagtccttggtgcgcttggccatttcggctaccagttcttggttcttagcgcttaaaatggcggtggcttcctggttagtcatcccgtcaacgagcggcgccacttcgtcaacgaagcggtggaagtattcgcgggcgtcctttaaatagtcgaggtcgtcttgcaagaactcggcgtggtgggcttccaccagcatcgacagggcccggtacatccagtaagccgacttgaagtcgacgttcatttccttaggcgtgttgcggtaggaggcgtcaacttcgtcggcgttaccaaagaacggcacgtacggggtgaaagtcgggatcccaaagctcatccacatgatcgtagaagcggcttcggggaggtcattgcggacctgcaggacgtgggagttttgggttcggttcaaagagattggccggaagaggcgcttttcttgttcggtgccctcgtggcccagtgggtcgtaaaccgtgccctggtagtggctagataggaattgttcgacctcttctagggtgatcttgtggtcggcctttaatacgaagggcaggtcgaagtccagcgggtcgagcttaacgtccggggataagaccaggtgaccgtaccactggcgcggggtgttgtagtgttggtcaaagacggtggcggtcccgaagatgcggcggaagttccagccggacaggtccgggttcaaatggtggtcagctacgaattcttggatcccgtctgaccacatgaagttggctgggtcgtcaaagtccacctcttggatcgccacccggttaccagtcacggcgtaggcgtcatcgggaatccgttgggcaacccagtggtggccggtgacaatttccatgtaccagacgtcgtttttgtcggagaagatcaccccgttaccttccgcggagccgtacttggcgacgaggttccccaggtaggcaaccccttcctgggctgacttaatgaagggcaggaccattgccacaatcacgtcttcgttgaggccggattcgaggttgagtgggtcaaaggccagcacccgttcgttggcgtagacgctttcggttgccgacatgccgacgttatattcgttaaagccgttttcgtcgtagaccccctcggtggtcaaattgacgttgggtaccccttggtagcgggcgccgttggccggccggtcgccgacgaagtggttgaggtaggacttaacttggttggggtggtccttataagtcgggtagaccacgaagcgttgcggggtcagcggaccgtaagtgtcgtcgtttctggccgccatcgtcgagccatcaatggtggcctgtttgccgacgagaacggtggtacaagcggagagtttcttttccatgattgaaaatccttccttatatggtgatggttacattgtaggcgtgcggtaaggtggggtcaaacgtgggccctgccgagtagctttaagacggttagggtgatcaggttgatcaaaagggccaggcccagtgcccagtagaccgggatcataaatgaaagcagggcgcccttaatttgagtcggggtaaagaagaggctggcgatgattaagactagtaggtaaaaggccaccagaatgaagaggccgtggctactgttttccaggtcggcggtcgacaggtcaaaaccgccgacgctgatgttgattaagaggaccacccagattaaaaccttccaccagaccaggtcgccggtggcggtggtagagaccccggttgccaggctctgccaccaagcaaagattggtggaaccagccagcgggtcaaagccaccagggcgaccgtaccgccgatcaagggggcgacgccgataaagaagttaccactgcgctggtataaggaagtggtttgccaggcgtgctggacgtagccgaggctagtgtcaccgtcgtttggacggggaatgcgtaacaaggcaacgcccttaatttggtggcggaagagcagggcgacgatcaagtggcttagctcgtggatgatgatgccgatcccgcccccgatgacctgggcaaagaagccaaagtagatgaccaccaatgacttgttacggtgggaaaccagggacagggcgctcccaaacaaaagggggatcaacagcaggtagaggctggcgtctaaaaagatctgtaagaacttggtcatcggctacttggtttgcaggtcggcgaaggtggcgttcaccaacttggcgaggtcctcggcgtttaactgtaccgagcggcccagttgcccggaggaaacgaagatcgttggcgtctccttggcttcgttatcaatgaaaattgggtaatggtgcttttcgtaaatcccaaccggggtgttggcgccgtggacgtaaccggtcgtcttcaagaggtcctttagggggaccatgtcgacctttttgttgcccgacacccgggcgagcgccttttcgtctaagtggcggtcgacggggaccacccccactaaggggccggtgacgttaccggtcaagaccagggtcttatagatcaggtgctcatcaacgtcgccgtggtcaaccaccatcgtttggacgtcgccatcttgtttagtcggaaagtgggcctgctggtaggcgatcccgtttttatcgaggatttgttccacctgggtcttttttaacttgctttttttcttgctcataaattggactccttttcgctggccgcttccgaatttggaacggtccaataatttaaatgtaggtaaccaaattttcaaaggtatggtatcctaaatacgataagcatagcatacacgaacaggtaaggacggggaagattgatatggcagacctagtataccgcgccgtcatgcgcgacttaaaacagaagatcctggcccaccagtaccccaagatgaaactccccgatgaacggacgctgagcgccgattacgaggtgagccggagtacgattaagcgggccctagacgtcctggtccaacaggggatcatcttcaaaaagcgggggtcggggaccttcatcaacccgctttacttaaagaaccaggcgatgttttcttacgaggggagcaacctggggatcaccgatagctttaagtttgacggccgcaagcaggcgatcaagcttttgaattaccaggtgattccggccgacgaagaaatccaacaggacctcttcttgagtgaggacgacttcgtttaccggattgaacgcttgcgtttgattgacgaccaacccttcatgatcgaaacgggctacatcccgattaagatcaacccgaccctgtcgtcgtcggtggtcgaagggtcgatttttaactacttagaagaagtgatgaacaagaccgtcacccgttcttacatgaccttgaccgtcgccccgtccacggaaaacgaccaaaagctcttaaacttgacccccaccgaaccagtggggatcatggaaggggtgttctttttagacgatgggacgccctttgaagtttccaacatgcgcgtccactataagtacatgcgctacaacacctttgtttcaattaataaggagtaataactgatgacaattaaggcaattgccgtcgacatggacggaacctttttgaattcccaaagcgactacgatcacgattacttcgccaaagtgtacgacctgatggtggccaagggggttcagttcgtggtggcgtcgggtaacccccattaccaactagaagatcggtttccaactgtcaaggaccagctagccttcgtggccgaaaacggggttgagttaattgatcacggcgagttggtgtactgcggtgaagtggccatggagacggtggaaagggtgaacgccttacaccaagcaatcgtcgggagccacttcatcatttcggcttacgatacggcctacaccttcaaggatgaggacccggccttcgtggagcacgccattaagcactacccccacatgaagcggatcgacagcctgagtgaggtagacgacaaggtcaccaagatgatgatggatgtgcctaaggagcggacccacgaactgcaggctaaaataaacgcggactttgccggggtgctcgaggccgtttcgtctggctacggcaacctcgatatcatcgtggctgggatggataaagcaaccggtttaaaggaattagtcaagcgccacgggttggacccggccgacctggtcgcctttggtgacggccaaaacgacctgtcgatgctcaattacgtcggtcaaagttacgggatggccaacggggacccgcgggtactagcggtaaccaaatttaccgccccgactaatgatgaaaatggggtttttaaaacgatcgaaaagctcttaactgactaggagttccgggtctcaattgacaagattggtttaaagtgcccgggaaaagttaaaattgggtgaaattgatacggtccaatttttaaaaaggttgactttgacgccaaatcggttatcatagaaagcgtaaattgatctgcgatttacaatgcgttatacaagtcaaacgtagttatcttttattgaattgaaggagtgtatattgatggcagtagattacaattccaaggaatacttggaaactgttgatgcttactggcgcgccgccaactaccttagtgttggtacgctgttcttgatgcacaacccactgttacgccaagaactcaaggcttctgacgttaagccgaagccaattggtcactgggggacgattgttccgcaaaacttcatttacgcccacttaaaccgggttatcaagaagtacgacctgaagatgttctacattgaaggttctggtcacggtggccaagtgatggttaacaactcttacttggacggttcttacaccgaaatttacccggaaatcacccaagacgaagccgggatggctaagttgttcaagcacttctccttcccaggtggaactgcttctcacgccgcaccggaaacgccaggttcccttcacgaaggtggggaattaggttactccctttcccacggtgttggggcaatccttgacaacccagaccaaattgctgcggttgaaattggtgacggggaagccgaaactggcccattggctgcttcatggttctctgacaagttcatcaacccaatcactgacggtgcggttctgccaatccttcaaatcaacgggttcaagatctctaacccaaccatcctttcccggatgtccgacgaagaactgactaagtacttcgaagggatgggctggaagccttacttcgtatctgcatacgcaggtggcgaatttgatggcctcaaggaacacatggaagttcacgaagaaatggctaaggttatggatgccgctgttgaagacatcctggctatccaaaagcacgctcgtgaaaacaatgacgactccatgccacaatggccaatgatcgtcttccgtgtaccgaagggttggactggtccggttaaggacttgaacggcgacccgatcgaaaactccttccgtgcacaccaaattccgattccggtgacccaagacgacatggaacacaaggacatgctcgttgactggatgaagtcttacaagccagaagaactgttcgacgaaaacggtgctccggttgaaaaggttgttgctaacactccagaaggcgaccgtcggatggctgttaacccgatcactaacggtggggttaacccgaaggaactcgtgatgcctaactaccgtgacttcgccgttgacgtgaagaaccacggtactgaaatgcaccaagacatgctcgaatggggtaagtacatcgctaagatgatcgaacttaacccaactactttccgtggcttcgggccggacgaatctaagtctaaccgtctttacgctgcccttgacagcgggaagcggacttggatggaagacatccacgaaccaaacgacgaagatctgagccccactggtcggatcatcgactcccaactttccgaacaccaagctgaaggttggctcgaaggttacaccctgactggtcgtcacgggttcttcgcaacttacgaatcatttggtcgtgttgttgactccatgctgactcaacacatgaagtggttacgtaaggccaaggaacaatactggcgtcacgactacccagcattgactttcgtggacacttccacggtcttccaacaagaccacaacggttacactcaccaagatccaggtctgttgacgcacctttacgaaaaggaacgtccagacatgatcaaggaatacctgccagccgacacgaactccctgctcgctgtctctgacgtggctttccgtgaccgtgaatgcatcaacgtgctggttacttccaagcacccacgtctccaatggttctccatcgatgaagcaactgaactcgttgctaacggcctcggctacatcgactgggcatccactgaccaaggcgcagaaccagatgttgtctttgcttccgctggtactgaaccaactgaagaagctctggccgctatcgacctgcttcacgacaacttcccagaactgaagatccgttacatcaacgtgatcaacatcatgaagttgatgacgattgctaagaacccagaaggccttagcgacgaagaattcgaccgttacttcactgctgacaagccagtgatctttgcatggcacggcttccgtgacatgatccaaagtctcttcttcccacgtcacaaccgcaaccttcacgtacactgctacgaagaaaatggtgacattaccactccattcgacatgcgtgtcctgaacaaacttgaccggttccacttggccaaggacgctatcttgagcgtacctggttacgaacaaaaggccgttgccttcgcacaaaagatggacgacatggttgctcgtcacaaccacttcatccggactgaaggtaaggacttaccagaagttgaagcttggacttggaagggcctcaagtaacaacgattgacttaacagcattgtaaaaaatgtgaaaaagaccatcccgcctcggggtggtctttttttgttgtcaaaatgaaatactacgcaaaataaaataataattttgattatttaatgtggaggggttgaaacttttattattaattttatcttataagtaagataaataaaattatcaaaaggtgttttagtaggttaaagtcactattttgtgtgttaggtcaattaaggattggggatctggactaacgcagggaaaagggggagaacaccatgaaaattaatgttaaagaggacctcaaggaactggttaacttcgaaagcaacaaggacgacattaagatggtcaacgctgccggtgacgtaaaagaggataagtacgacggaccaacctacttagcgatctttacttggatttatgctttgtgtacgtcccgttataaaacaccccgcctctttggtgaaatcttcaaatacacgctttacgtttgggtagtaggacttgtcttgatgtggccctcgatcgctttatcatgacgcaagtaatggagtacaacgataaatttgagaatcgagcacatcggggattcaaggactgtcacgacacgcttgattcgatgttttagaatcgccaattcatgcgggcgaagtttccatttttacacaacattcttgacactctccatgtttatctggctacggtttacattgcctcaatttgcatcttacttaagtagttttcagacggaccctagtcttcattataaaattttcttagctgtataaaagccggcttattattagagtctacaaactctaataataagccggcttttatacattatcggataactaataccgaaattggtgaatatttagccatgtaagctgcttgactaccaaagtgacgtcgaatgccccgcttggcttcagagccaatgattaaaacatctggttctacgtgtgtaataatatctttcacaatgacttcaccaggttcaccttcagctactaaggctcgtacattcttgacaccagcggtttgagcttctttttggtattctaagatatgcttttccagctcagtttgctcgccgtaaacgaagtctttacttaaagcttgatacacgttcatgtcatctttttccaagacagaaacaataactaattctgcttcatcttgaatggcatgcttaaaagctaatttagcatcagcagaatcatcgacacctactaggattctcttaaaagctgtactcgttatttagcatcactctcagtttgatgagctgccagcttagcagcgtaacgtttattgccgcgatataaatcataaatggtccatgccaataaggctaaaattccaataatcaaaatattggcaataattgaagataggttctgttcagctgttgacggattatctccgaagaaacctagaattgagtccggtaatcctttaaggttcaaaaaagttagcgcaataactgagatccaccctaaaaccttgacccatagtgagtttttaaaacgttggcccatttctacctcactatttgtcatcattagtaacggcaacatggagaatggaagggcaaatgccaagaatacttgggagttattcattaaattatttaaggcagtatgttcagcaatagcactttttccgctggtaagggcaacacaggtcaaaacaggaataactgaaattaaccgggttactagacgacgtaaccagagcggcatacgcatgtgtacaaagccttccatgattacttgccctgttagagtacccgtgatagtggagttttgcccagaagctaataatgccactgcaaataggaccgataagaccccagatttagcaactgcaatcaaaacgccgttacttaacatagaagtattagatagagcttgatacaatccgaagaatgaaggatccttgacagctccggtcttgaaaacagcaacccccatgattaataacaatgagttaacaacaaaagcaaaggatagttgaatgtttgaatcccaagcggaaaacttgactgttcgagcaatatcctcctcatcatcatggtcaacttttcgtgtttgtgatacggccgaatgcaagtacaggttatggggcataacggttgctccaatgatacctaaagcacctgataagggtgtcataccagcaactgatttagaacctgaaaaagtatcggcagtagggacgaggcccttaattacgccgccccaatctggatttgataaagccacttgatagacgaaaactgctaagatcacaaaaattaagcaaacaacaatagcttcgattttgcggaaaccaattttagttaataatagcaaaactagaacatcaaaaacagttacgaaaactgcaataaccaacggaatattgaacaggagatataaggcaattgcggccccgataacttcggcaatatccgtagccataatggccatttcggttaaaatccataggacaacccctaatgacttgctagtccgggcacgaatggcttgggccaaatccatctgactcacgataccaagtttagctgccatatattgtaaaagcatcgcaatcaaacttgacattaagatgacagacattagcaggtactggaaattttgcccaccggtgattgaagttgaccaattaccgggatccatgtagcccacggcgaccaatgcaccaggccctgaatatgcaaataaagttttccaaaagctcatatttttgggaacttcaattgtgccattaatttcttctagcgaaggaccgttagcatattctattaacttatgctttttgacgctccccttttcttccttgttcaactaaatctccacctttctacaattctacaaatagaataacatttaagactatgttattgtacaacaaaagtcataatattcaaacatttttttaggtacgcttaaaattattccgcttgtgggtgaataaaagtaagggagtagaacgtcgcctacctgaggggccacttgctactccctttatctttcttaactacttttaatctttccttacccgcccttcacaccttcttcattgcccagcggtatattataaccatcctcaattgatttttcttcttcatcaacgaagcctgtctcctcccaatcgtttcggcttcgctgacacccaaggcccacgggaattcttttccgcgggctttccttttgcaatccgcctttcgtgttataatacgaaaagatccatcacgtgtgctaaattattagccctaaataatgagaggtgacgactttgaataacaatcacgacgatgaacaacagcatttatcgcgcgtcgaactctacgatacccaaaagagtcatcgcacgaattcaaaacgccgtaagccccgccgccggggaccgaagaagccgggctttttcgctagtctctttgggggcccacagcggccgaaacggccaaagcgccggcgcccggtagccccaatggccaccgccgccaaccgcaaggggcctaaccgacggcctaaaaagcccgttagcaagcaaaagaaactcttccgcttggcgttgggcatcttgctggccatcctggtggtcatgatcgccgttttcgtggtcaagcaacaaaacccggttaacaccagctccgacgaaatctcgacttcttcaagctctaagtccagttcacacaagaagaagagtagcagcaagaagtcctcgagttcttcttctaccgactaccaggaaacctacacctactcatactctgaaccggaatcgagttcttcttccgtgtactcctccagttcctctgcttctagcagtaacgataaccagtcgacttacaccaacaccactaacactaatacctacgggtacggtaacaatggcggaagaactggcggaacgggaactggtagtaatggcagtaccggtgatagcaatggttctgatagtggcaatagtggcagcactgatacaaatggctctcacactaccacccaaaacggaacccaaggtggcacggcaaaccaataaaactaagccacgccttgacatgccccttgagcatgctataatcgtttcaaatgcgggatacgcctaactacaagcggtaaaccagggaagggtgccatggctggaagcacctttacacggagtagttaaggtaccaccccatttcttgccccccgaaataagggggaccgggtcgtgcccgttaccacaccatagagaggattttaaatcctgaagatgggtggaaccacgctgaagttgttattttcaacgtccctaacgttgccaaagtgggtagcgttaggggcgtttttttattccaaaggaggagtttacatgccacaagttgccatcatgttaccaaacgggaccgttgaaaaggtcgaccgtgaatcaaaggaaagtttagacgccctgcgccaagtcgccgccctcttactcaaggctgccttgcaagaccaattcaaggggatccgcctcggggaagccgttgccgaagaagaccaattcttcgttgactccgataaggacaaccaacaagtctccgctgacgaattggaaggcttggaaagagccgttaagaagttagccaaggaaaacctcaagatcgaactggtcaaggtcagtgttgacgacgccgttaaggccgttgaaggtgaccaattctccagcgaactacttaaggaaaacgccgaagacggtcaagtatccctctacaagatgggcgacgcaacgatcttagcccaggcacccatcatgctgtacgctaacctcgttaagaacgttaagctcctctccgtggccggggcttactggaaggggatgtcctctaacccaatgctccaacggatttacgggaccgtcttcttcaagaaggaagacctggaagccgacttgaaggcccgccaagaagcccgcgaacgtgaccaccgggtgatcgggaaccaactcgacttgttcttcgttgatccaaaggttggtgccgggttgccgtactggatgccaaaggggtccacgattcgccggacgatcgaacgttacgtgatcgacaaggaagttggcgatggctacgaacacgtctacacccctgtcttgatgaacctcaacgcctacaagacgtccggtcactgggaccactaccgcgaagacatgttcccgccaatggacatgggtgacggcgaactgctcgaactgcggccaatgaactgcccatcccacatccaaatctacaagcaccacatccggtcttaccgtgaactgccactgcggatcgccgaactcgggatgatgcaccgttacgaaaaatccggggccctctccggtttgcaacgggtccgggaaatgaccttaaacgacggtcacaccttcgtggccctagaccaaatccaagacgaattcgccaagatcttgaagctgatcatggacgtctacaaggacttcaacatcaacgactacaccttccgcttatcctaccgtgacccgaagaacaccaaaaagtacttcgctaacgataaaatgtgggaacgcagtcaatccatgttaaaggctgccatggattccatgggactggactactacgaagccgaaggggaagcggccttctacggaccaaagctggacatccaaaccaagaccgccctgggcaacgacgaaacgatgtccaccatccaactggacttcatgctgcctgaaaagtttgacctccactacgttggtgaagacggtaagcaacaccgcccagtcatgatccaccgtggggtggtcggcaccatggaacgcttcgtggcctacctgaccgaaatctacaagggagccttcccaacctggttggcaccaaaccaagtcaacatcatcccggtttccgatgaaaagcacggtgattacgctgatgacctggcccgtgaattccgggcagcccaactgcggaccgttgttgaccaccgcagcgaaaagatgggttataagattcgcgaaagccagacccaaaaggttccgtacaccctggtagttggggaagacgaagtggctaacggcaccgtttccgtccgcaagtacggggaaaaggatcaagtaagcatgtccaagcaagacttcttggacctgatcttacacgacgttgctacttactcacgcgaagactaattattaagcgaggaaaccctaataggacggactaggcgtcagccgccgtttattatccacgctaaatccatatacaaagaggctatggcaattttgccacagcctctttgtcgtctttaacacttttatcgggagaaaaatcaattgaagatcattatcgtaactctttgtctattaaccatcggcaccctgctttggtccctcaagcaaggcaaccatgctaagcgtccattttggtggcgcctaaccctgatcattgccactttgaccctctttaccgccgccattggtaccaccactaacgttgacgccgcgcaaaagccgacggtgattattaaaaaactcggccactcctccatggttaaggaaagcaaggcccacgacagcctgttggttaaacgcgattccttgggcgccaagctagccagcctcaaggaacaattgagcgccgccgagtctagcagtgaggaagctagttctaaagaggcagcggctagcgctcaggcagccagtgctagccaagccagggctgacgccgatacgcaaccaagttacggcgccgctacgtcaacgaccactgcgggaaccgtcgccaccgggaacggctccaatgtcatcgtcggcgatgcccgctccaagaagtaccacttgccgacccaagccacttaccacatcaaggccggcaacaccgtttacttcagcaccgagcaagaagcgattaacgctggttacacgaagtcaggacggtaagcaagatgaaaaacttccaccacaaagcgaccatctccgtcctcggctttgccgcactgttcttaatgaccgtgggcctagtcacccactccggcactaaggaatcggcggtcgtggccagtcccgcttccagcagttaccgttacgaccgtaccgaccaacggcgggccgcttcttttagcaaggaaaaccagaccctccaaaaaaagatcacccacctgcaaaagcagattaaagaaaccaaggaagaacttagcgactacggcgtccaaccggcaacccccagcaagcaatccagccaagccggcactaatttatccaacctggactataccggccaagacgtcatcaccgttgacaataatcaaccaagcttctcggaagccgacttgtcccttgcaaacggcgcttggcaaagctacgggaacttggaccagtacaaccgtcccggggcggccaatgcgatgctcaaccaatcgctgatgcccaccgtcaaacgggaagccctgaccgtcgacccgactggttggcataacaaacgcgtcaatggtcagtggctctacaaccgctcacacctgattggctaccagctaaccgggcaaaacaataacttcaaaaatctgattaccgggacccgccagttaaacgaccccgacatgctcaagtacgaagacgaagtggccgcttacctaaagcaatccccggaccactacgttcgctaccgggttaccccgatcttccggggcaacgaactcctcgcccgcggggtggaaatggaggcccaagcggtcggcagcgacgccgttaagttccacgtgtacatctttaacgtccaacccggcgtcaccttaaattacaacgacggtactagtcaggtgaactaggtcgtttcatatgaaacaaagaatggaagtgctcaccaacctactcgacaggccgttggcacaggttaacgcgacagcggcgttctgtggccagacttagccactaggcctgtggttgggaagcacgttatctgagtaaccaccgaagattaaaaaggcgacgatgaccgaattagtcatcgtcgcctttttagctaattccccgtaaagtaatgcttccagagctggttaacgttgtacttatgctgcttggtgctcgaggaccaaaagcccaccttgacgaccccgacaatcttattcttcggcacaaagccccagtaacgactgtcgttagagaccgaacggtggtcccccaaaacaaagtacattccctttgggaccttagtggcgcccatattcttcatccagttattctcttcggaaattgacgctaaagtccaattccccgtcccggtcgttcgttggtacttagagatgtaggattggttggtcttcttaccgttgacgtagatgtagccgttcttggcttccaccgtgtcacccggtaaggcgattacccgcttaacgtagtcggtcgtttgcgaaacctgggggtcaaccccgttggcatcgaagacgacgacgctaccgcggtgaatcttcgacgttttaacggccaccacccgctcgttattttgcaggttcggttgcatcgatggcccgtccactttcacgagttggaaggaaaattgcttcactagcaacgcgatgatgagcccgatcgccactggaatcagccagcttaaggtttgtcgtagtgctttcattttgaattctagccccgcttttttattgatcacccttatcttacaacaaaggtagcgtttctcctagtcagaagttaattctctagccgggcgaccacttgacgggcgacggcaatatcgccagggtagggagtatcaacccctgccaccttttggtactggtcagttcccttaccggcaaggacaactaagtcccccggccgggcggcttggattgccgtttcaatcgcttccctgcgatcggccacgtattcgacttggccaacccgatcgtgatcgatgtgggcgtcaatttccgcggcgatcgcctgggggtcttcaaaggcgggatcatcggtcgtcaaaattacccggttgacccgctcttcagctagggccttaccgaggtccggtcgccgtgaaacccccttgttaccaggcgcccctaagaccaccgtaatctggctcggctctccttggtgttgctggccctttaaaaaggctaagagacgcttaacggaggcgtagtcgtgggcgtaatcaacgtagaccgtgccgtgctcttgggtcctaatcacttccatccggccggcgatgtggacctgcccaaaggcctcctggatggttttctttttgaccccaccaatggcggcacaaatagcggcggccgtagcgttacccacgttgtaatcgccagccacgctggactggtactccccgtctaacatcagggcgctcccacggtcactcaccccggttaactggaagttagaaccagccaagccggttgactggatttggtaagccaggtctaagtcagggtgactgccgacttccccaaacaggtaaatcttgtccggggccgtcgagaccttggcggcctggtaaacctcttcgaaatggtccatctgggtgtttagcacgcaaacgctggaatttaagagcagctgctccttgcaaaagaggtagttggcaaagtcggggtgctcattttgaccaacgtggtcgctggaaatattcaaaaagaccccgatcccgaagtgtagggagtagacccggtcgagcaagtaggattgcgaagatacttccatcactaggtgggtcatcccattatcgacggcttggcgtagatagcgaaagaggtctaacgattcaggggtggtcaacttggacttgaagacgtcacccttgcccaacgaagtatttaaagttgagatcaaggcggtccggtcgtcggtccccaggttcagggccgtggcggcgaagtaggccgtcgatgtttttcccttggtcccggtgatcccaatcgcaaagaggtcgttggacgggaaaccgtaaaaggcgttggataacagcgccatcgcccgttggatgttggtaacgatcagggccgtcgccccgttttggtagctttgttcggccacgtaagccgttgccccgcggtcaatcgcctcgtttaagtaatcctctttaaaggccgcgcccttacaaaagaagagggtttcggactgaacgagcttggaattgtactcaacgtggtagaagaagtgctggcggtagttttccgtccgcaccaagaggccgtgttcggtcagcaaagaaatggccgaattagtatcaatgtgagcttggtcgattatttgcagggtcatcgcattatttctccatcaattgcttagtaatctggtagtcgccttggtaaggaacgtccttgcccttttcgtgcataaaggtttcccgtcccttggcggccataaagagggcgtcgccaggcttagccattgcgtaggcctgttcaattgccgccttacggtcaacgttgacgatgacctcgaggtcggggttatcaatgttttccttaatgtcagcggcgatctggtgagggtcttcaaagaagttatcctcagaggttaaaatcgccacatcggcgtactgggacagggcgcgcccaatgtctttacggcgggattcggccttgcccccagccgccccgatcaccacgatcaagcggccgtctttaaattcgtgcttcatgaagttgaagctggccgtcaggctcaagtagttgtgggcgtaatcgacgcaggccaccacgccctgcttgtccttgataaattccatccgtcctggcacggtcgtttcggccaggcccgcccgaaagtcctcgctgaccggggccacttgggccgccacggtcaatgcggccagggcgtttgcaacgttaaagtcccccggcatcataactcgaaaatcgccgtcaagcttaggcagggccgggttagcggtggtaacggtgaagtaaccgtgttcacccagtcggtattggtaatcggccgccgattgatcactcccaaatgaaattacctgcttgcccaggtcgtgtgccttttcggccaggtaatcgtactgactgcactcccggttaacgacgaggatcctgcagttgtcgatgatttcactcttgcaggccaggtagtcttcaaagctcgggtgttccaccggactaatatggtcgggcgagatgtttaaaaagacgccgatatcaaggggtaggccaaagacccgcgacttcttataggactgggaagaaacctccatcaccaagtacttcatctggttgtcgacggcctctttcatcatcctaaagaggtctaaggactccggcgtcgttaagtgggccgggatgaaggtttcgccgtccaaacactcgtcaatcgaggaaagctgggcgaccactttccccagggccttggccatgacgtggcgggtgaagtaaaccgaggtcgtcttccccttggtcccggtgtagccaatcacggtcaggttgcggtccgggtagccaaagaaggcccgggacacagtcgccatcgccttttgaatatcggtaacgatcacttggggtaagtcaggatgctcactagtttttaactgggcggagtaatccgccggggccatcgccacactcgccccctggttagcggccatcgtcaggtacttaggatcaaacttgaggcccttacaaaagaagagggtcccctccttgaccgtccgcgagtcgtaagacaggtctaacacggtgcggttggccaactcctccggcgcccggtcgtgccacttgccggccacaatcaattccttgaacaaccctgcgtcctttaagaccgtgataatttcgcttagcgtcattgtcattattgcattacctcagcatccgcttgcttcgtgtattccggcacgtagttatcgataaagtagagcttgtaccataccaagaaggtgtaaatcgtccacaacttacggcggccgtcgatcttttggtggtagttgtcatcggctaactgcaagatcttgtcctggtcgaagaattccttaacgaagtcctcttcaaatagggcccgtacttcttggtagtacttgtcttcgtggagccattcgcgaattggaaccgggaagcccatcttcggccgggtcgcccattcctctggcaggtgccggttagcggccatccggaaggcccacttggtccccttgtagttaaagaggtacttagttggcgtgtgggaagccacgttcatgacttccttatccaagagcggcacccgtaattctagggagttcgccatactcatcttgtcggccttgagcaagatgtcacctggcatccactggtgcaggtccacgtattggcgcttggccacttcatcgatatcctttggttcgatcttgtcaaagtacggggccaggatttcttggatcgttggtccgcaatcaaagtccttgttcaagacgtcgctcgcctcttctggcgagaagatgtaggcttgcccgacgaagtcttcgcgggccggggccatggcgtggtacatgtgcaaacgaccgtggaagttcttgtggttcttcagccattccccaatcttgtagcgggttggttgtggcaacttacgcatctggtcggttacccagcggatcggcttagaggaagtgttgaagccgtagtcggtgtagccggcaaagagttcgtcggccccttccccggataacatcgccttgtagccgttgtccttagccaacttagtcaagaagtacaacggcaccacggacgggttagaatccggttcgtccaggtagtactggatggtcggaaaggcgttgaaggcttcctcgttggtcagcttcttgtcggtgtttttcagcttcagcttttcggccagttcgcgggcctgcttggtttcgtcgtagcgggagtcaaacccgatcgagaaggtgttgtcagggcgcatcatcgccgttacgtaagaggagtccaccccggctgacaagaaggaaccaaccttgatcccggcatcggcaaaggagtgggccttaaccgattcgtcaacggccgcttcgatcttatcgacggcctggttgaagctttccttgtccggggagaagtcggcgtcccagtactgttccattgagaattcgccgttcttgtaacggaagaagtgaccctctggcaggcggtaaacgcccttaaagaaggtttcatcagtagcggggtactggaaggtcatgtacggctttaaggcttccttgttcaatcgcttatcaaagttcgggtgatccaagaaggacttgatttcggaaccgacaaagaaggtcccgttcatcttggcgtaatacagcggcttgattccgaagtgatcgcgagccccaaacatttcgccggtctcccggttccaaataacgaagccgaacatcccgcgtagcttcttgacgacgccttcaccccactcttcgtacccgtgcaggataacttcggtgtcggaatgagtgctaaaggtgtgaccggccttaattaattcttctcgcaggggcttaaagttatagatttccccgttgaagatgaccgcctttgagtcgtcctcgttaaagatgggttggttccccgacttaacgtcgataaaggacaaccggcgaaaacctaatgccgcctgctcgtcaacaaacattccggaatcatccggtccccggtggataatccggttcatcatcttttgaatttgaacttccttttgttgtggcttctcattatccacgaacgcaacaattccacacattgttttcaactccaattctcgttttgtctgggtcatttcccgggaaagatctctccccaatggacccgcaaagcgccgtaaaatctatataatgatagtctttttccccgttcatgtaaaccgatcgaacccttaaggatttctaatgttccacctgcctttttatgaatatctgacgaatattacggtatttgttttattttatgttagaatagattgatcaattgtgaaattttatccatttagaaagaagggcttcttttgaaatcttcagccgacgctgccgccggtaccgaaaatcacgaaatgcggcggagcttaaagacccgccacttatcgatgattgccttgggtggttccatcgggaccgggttcttaatcgcttccggttcggcaattgctaccgccggtcccgggggcgccttagtcgtttacgccctaatggggatcatggtttactttctgatgacctctttaggggaaatggcgaccttctcgccgactaccggctcctttgttacctactctgccgattacgtcgacccggcctttggctttgcgatggggtggaactactggtttaactggaccatcacgatcactgttgacgccgtttcctgcggggtggtcatgaacttctggttcccccacctaccgtcatggattttttcgtccgtcgtctttgtcctaatcgccctgatcaactggctgtcggtcaaatcttacggggagaccgaatattggctctcctttatcaaggtggttacgatcggcttcttcttggtggtcggctttttggttatcttcgggatcatggggggccactccgccatcggcttaaagaactttacttacaaacaagcaccgtttgttggtggcttcccgtcaatgtttgccgtcttcttggtggccgggatgtcctttcagggaaccgagctggtcggaatcacggccggagagtcggctgaccccagacacgccgttcctaaggcgattcactcgaccttctggcggatcctcttgttctacttactgtcgatctttgtgatggcttgcatcctgccgtacaccgacaagaacctcctgtcgtctagcgtcaaggacgtttccatgagcccgctaacgatcgtctttgaacgggccggactagctgccgcggcctcagtcatgaacgccgtgatctttaccgccctgttgtcggctgccaactccggtttgtacgcttcaacccgaatgctttacacccaagccaaggaaggctttgcctggaagatctttggctacgtcaacaagcgcgggattccgatctatgccatggtcgggacgatggtgatctccctagccgtgttcgccacccagttcttgggcaaggaagcctacaactacctaattaacgcctccgggctctccggctttatcgcctggctcgggatcgccgtggcccactaccgcttccggcgtgcctacgtcaagcagggacgcaagctcagcgacctcaattacaaggccaccctcttcccgtttggccccatctttgcctttatcctctgcctaatcgccgttggggggcaaaacctgggggctttcgctaagcttgactgggaaaacatcctgattacctacatgtcagtgccgttgtttgtgatcttatacatctactacaaggtcaagtacaagaccaagttgattccgctagcagaggtcgacttggaggcccaccgcgactagaacggagtggtagcccactattctatccctccaacaaataaaatccggttacttcgtcaaataacgaagtaaccggatttttactttacagcggcgttggttaccacttctttacttatcttgcttcttcagcaattcgacaatttggccaaggtattcttcttccttggacgggccctttttgaccgcttcttcttccttctttggcattaccttgttgatccccttgaccatcaagaagaccacgaaggcgatgatcaagaagttgatcacttcgtttaagaaggaaccgtaacggaagtgggcggaaccgatggaaaagaccaggttggacaagtcgatcttccccaggaaaatcccgatcaacgggttaatcaaattggaaaccaacgacttcacgattgccgtgaaggcagccccgatgataaccccaacggccaggtccatcacgttcccgcgggcgatgaactctttaaactcttttaacatacgcatcctcgctttctcaattagttaaggtggtgcgcaccaccttaagaatcttttaatctatcatacactgattaggggtgatttggcaaagtcaaaatcccgcaattccttgtcagtttataaattatgtgtgaaagcgggttcagccacattaaacatatctttttaactattcatcagggcgccagaccagtcatttaaaatttaaaaccagaccatttgagcgaacacgtacttattaaacaatttgtgtttgttacttcaactttccctgccgcaggtacacggacaggatggccaggtcagccgggttgacaccggagatccgggaggcctgggcaagggtggtcgggcgaatctgctccaacttttggcgcccttccgtggctaagccttcaatagcttggtaatcaatatcggctggaatccgcttagcttccatccgcttgaggcgttcaatcttagcctcttctttttcgatgtagccggcgtacttaagttgaatctcaacctgttctacttcctggcggtccagttcaacggccggcgcatcaacaaatttcagaagggttgggtagtcgacgtacggccggcgtaagaaggcatcggcagcgatggcatccttaagcggcttatcaccgtgggccaccacaaaggcgtcaatttcttcccccggtttgatccggaagtccttcaagcgggcgatttcgtcttccacccgttgcttcttttcttccatggccgccaggcgctcatcggacaccagcccgattgcatgtcccttttccatcaaacgaaggtcggcgttgtcgtggcgtaggatcaaccggtactcggcccggctagttagcaagcggtaaggttctttggttcccttggtgactaggtcgtcgatcatcaccccaatgtaggcgtcggagcgcttcaaaacaaacggttccttgccctgggcgcgcaggccggcgttaatcccggcgatcaggccttggccggccgcctcttcgtaccccgaggtcccgttggtctgcccagctgtgtaaagattgttaaccaacttggtttccagagtggcctttaattggtacggggctaccacgtcgtattcgatggcgtaacccggccgcatcagttcggcgtgctccaacccggccaccgagtggatcatctggtgctggatttcttctggcattgacgtcgacagcccgtccaagtaaaactcgtcggtgtcccgcccttccggttccaagaagacctggtggcggtccttgtcggcaaagcggacgatcttatcttcaattgacggacagtagcgtggtcccaccccttcgatcaccccagagaacattggggcgcggtcgaggttgttacgtaaaatttcgtgggtggtcgggttagtgtaggttagccaagaagaaatctggtctttgaccgggatgtaggaagtgtccggcgtgtcaaaggagaagtggtttggtgtttggtcacccagctgttcctcggtcttggagtaatcaatcgtgttcccgtccactcgtggcggcgtcccagtcttaaaccgctggaggtcaaagccgagccgctccagggcttcggacaacttaacggcggccttagagttattcgggccagattggtactggagttcgccgatgatgatcttaccccgggcggccgtcccgaccgtcaaaaccactgccttggcgtggtaagccgccccggtgttggtgatgacccccttgacggtgccgtcttctacgatcaggtcgtcaaccaccccttggcgtagggtcaggttcttttccttttcaatcgtccacttcatctggcggtggtaggcgtgcttatcggcttgtgcccgcagcgcccgcacggccgggcccttcccggtgttgagcatccgcatctggatgtaggtcttatcaatgttgtgacccatctcaccgccgagggcgtcgatttcgcggaccacgacccccttggccgggcccccgagtgacggattacatggcatgaaggcgaccatttccaggctgatcgtgatcaagagggtcttattccccatccgggcagcggctagggcggcttcggagccggcgtgccccgcccccacaacgattacgtcgtagtcgcccccgttgtagttaacaactttggtttccattctcgtttcttcctctactttcctaaacagaattggctaaagagctggtcaagcaactcgtcttggtaggtctggccggtaatttcccccagcgtgttccaagcgtcggtcatatcaatttgcaccaggtcaaccggcattccggcctcgatcccctccaaaacggcgttgagcgagtcaactgcctggtgcaacaggccgatgtggcgggcgttagtgaccatcacggcgccccgattagattcaatcccctcgttaaagaagcggtgggcgattgcttgacccagttcctgcatccctgcgtgttccaagatggaggtctgaatgaccgggtcaccgttaacgagttcggttagctcagccaggtcaacttgggccggcaggtcggtcttgttaaagatcaccatccggggtttttgtgcggtggcctcaattagcgcccggtcctcttcggtcagcaggcggctggagtcgatcaacaagaggatcaggtcggcggtttcaatcgcttgcttggagcgctcaaccccgattttttcgaccgtatcgtcggtgtgacggatccctgccgtgtcaattagcttcagtggtaccccagccacgttgacgtattcttcaatcacgtcacgggtcgtccccgctacttcggtcacgatcgccttatcctcgtgcaagagggcgtttaaaaggctcgacttgccgacgttcggtcgcccaatgatggcggtggccaggccgtcgcgtaagaccttgccttccttggccgtttgcaagagggtttccaagcgttggcgaacctcgctggccttttcctttagcatcttagtggtcatctcttcgaccgcgtcgtattcggggtagtcgatgttgacctctacctgggccaaaacgtccaggatatcttggcgtagggccttaatcaaccgcgacaggtccccgtcgagttggtttagggccaccttcatcgacttgtcagtcttggcccggatcagatccatcaccgcttcggcctgggagaggtctaaacggccgtttaaaaaggcccgcttggtgtactcaccgggttcggccaaccgcgccccgttggttaaggttaattgtagggcccggttagtcgccaacagccccccatggcagttgatttccaccacgtcttctttggtgtaggtcttgggggctaacatcaccgaaaccattacctcatctaccgtttccccgcttgcgggatcgatgatgtgcccgtagttaatggtgtggcttttaacttggtgaagatccttgcccttaaaaatccggcttaccacgtctagggcctggtcgccggacacccggatgattgagatccccccttccccaaccggggtcgagattgccgcaattgtgtcttgctctgaatttgccatctgttggtcctttctcgttcaaagaaaaaagtgcccctccacgaagccccggtttcccgcggtcatggtcaaagcactttcactactctaacgaagttttcaattttaacgtatttattgtaagaactttgcccgcccttgtcaattatttgggggcgatcacgaccgagcggaagggttcacgcccctgcgaataggtcttgacgttcggattatcctctagttgcttatgcaagagtttgcgttccctggccggcatcgggtccaaaaagaccgcttggccgctagcgatgacgtcggtgaccgcccgctccccaatccgggtaattgtttgcgcccgcttggcccggtagccttcgctgtctaaggtcacctgggcgtccttgaccccctggtagtttaaaaaggcgacactgagcacctcaaaggcgttgatccgccgcccgtggtagccaattaccctcccgggcgttggtgcgttcagctcaatcgtgacgtccttggccccgctactttgaaccgtggctgaaacgtcgacccctagtgcccggtaggcctgctccaggtagtcgaccaacttggtagcggcggccgacatccgatggaggttttgttcgtggcgggcggcaatttccgccgggcttaattgaccgtccggcgccccttctggattgccttctggctgctcagtggccactggttcttctataagttgaggcgtttgctcggcggggtcttcttgttgaaccggagccacctcttctggtgacgatgacagtgtgggcgttgctggttcaaccactttcttgaccaccgcctcaatcttaaccggccgggcgcccaggccaaacaggccccgccgaccagggtcgaccaccgtgatggttaattccgcttgcggcttgttcaggtcttgttgcgcctttaaaacggcgtcttggtacgtttttccttggtactcactcattgacttccccctcgaaaaaaaaggcagggaaaatttcattttctcccggcctcttattctatttctaaattacttgcgcttgctagagtaggcccgacgcttggctttttcaatcttgcgttgcttggccttttgtgccgcctgctttgcttcgcgttcccgccgaatcttgaacgggttttggatcactaaggtctgaaccacttggaaggcgttagtgaccacccagtagagggtgatggccgccgagaactggagggccataaagaagatcatgattggcattacccaggtcatcgtcgtggtcatcgagttcttttctggcatcgaggccattgacagccaagaagaaatgaaggtaaagaccgccgccagaatcggtaagacgaagtaggggtcggtgtgtcctaactggagccacaagaaggtccccgtctttaattgggccgtccgccaaatggcttggtacaaggcccacatgactggtaactgtattaacagtggcagcatcgacgcaaacgggttgacgcccgcttccttgtagagcttttgttgctcaatttgtagctgctgcatcgtttcgcggtccttagacgagtactttttttgcagggccttcaattgcggcgccagctcctgggtcttcatcatggacttggtctggtaaaacatcattggcaagatgatgatccggatgatgatcgtaaagatgatgatccccatcccgtaaccgccaaagatgttggacagccaaataataaaccgcgaacagttgtaaacaatgtagtggtcccaaatcccggtactgtgactggtaatcggcttgttagaacatgccgccaacagcagggtgagccctaagatccccgtcagacttaagacctttttaccgtgttttttcaaaccttgatcctctctttacttttcctcaaacaggtgtgccaacgtaagtgcatggaccagattcttcttgatttccttcattgaaaggtcggccgccgatttacgggcgattaccaagaagtcaacgtcctgctttaattcgggcttaacctcgagcagggtttggcggatccgtcgtttgacccagccccgctggacggcgttgcccacctttttaccgaccgaaatcccgacccggaagtggggttggttcggtttttgcatctggtagatcacaaacttatgattggccactgaattatgagtttcaaacacccgttggaagtcgctttccttttttattcggtacgattttttcatttagtcagtctccaacccgttaaaccaaaaaagggccgggcaacgacaactacaacatcacgattgcagtatatgtggctgcccggcccctttatggttacttaacgtaacgatattatgcagataatgccttgcggcccttttgacgccgacgggctaataccttccggccgttgctagtgctcatccgagcgcggaagccgtgaacacgggcacggtggcgcttcttaggttgaaatgtgcgcttcattgttttgcacctccttagcagctgatttttttagtttctttattaaaacgtccgtttaaaaagagtcctctcttcaaacatacttttgaagtatagcatacttttgggagggaaggaaccgccaagtcggcgaaaaaaataaattccccttaacagttttccacaaataatccacagcgttgtgtatttatttttgcggcgtcgacttatccaccgccttatccaagggcttttgacttatcccaccccggtgggtaaagttatccacaagccggtggataacttttgaaaacgcggtcagatcggcgtttggagcggtggatatccccactaagctgtggataaatagaattaagccccagtttttccacctttccacacccctggggataatttccacacaccgttgtttataactggctttaaatttttccacctgtggaaaactccggccaggaatgataaaatatcggttgtaaattttttctaatgcattcagacgtagaggaggaatcattttgactgagctcgattctctttgggaagcgatccaaaattcattccgtaagtctaagggcgatacgacttacaaaaacttaattgctccggcaaaacccctcgacttcgctaacggcaggcttcgcatccagctgccctcccagtaccaccgcgacttttgggagcagctgaccgaccaggtcgtcgaaatcgtctaccaacgcaccggccaagaaattcgcccggactacgtgttggcaaccgatccgacccccctggcccaaacgccgccccggccacagtcgacctttaaagaggaaacgcccctcaacccggagtacaccttccaaaccttcattgaaggacgtagcaacatgatggcctacgcttcagcctttgcggcttccgagtccccgggtgaccagtacaacccgctcctgatttacgggggcgtcggcctaggcaagacccacttgatgcaagccatcgctaacaacatgaagtttcacaaccctagcgtacggatcaagtacgtaaccagcgaaaacttcatgaacgacttcgttaactctattaaatccgggacccaagaggagttccgccgcgaataccgcgacctcgacgccctcttggtcgacgatattcagttcttcgcctccaagggggagacgcaaaccgaatttttcaatacctttaacgtcttatacgacaacaaaaagcagattgtcctgacctccgataaggatccccgcgaaatccccaacctgacggcacggttggtctcccgcttcatgtggggggtcccggtcgaaattacctcgccggcactggaaacccggattgcgattttaaagtccaaggctgaagaagagcacctcgacgtgccaaacgacgtcttaaacttcgttgcccaacgcatcaacaccaacgtccgcgaattagaaggggccctgatgagaatccgggtcttttccgaactccaccagcaaccgattaccctcaaactggctaccgaggccctgcagggaatggttgccaacaccgaaacgacggtcaccattgacctaattcaaaagcgtgtcgccacctattacaacattaaccaatccgacattaccggcaaaaagcggaccaaaaacatcgtcgttccccgccagattgccatgtacctgtcccgggagttaaccgataattccctaccaaagatcggtaaagaattcggcggcaaggaccacaccaccgtactgcacgccatcgataagatcgaaaggcaggttcaagaagacgcccgcctgcagggggacttggttaagctcaaaaacgacctgcaagcctagttggggaaaacttggtcttatgcccagaattatccccaatttatccacaggtggaaaacttgttcttgatcggacctaccgacttttccacagcatccacaggtcctactaccactactaactatttttattaatttaaattaactatcagggaggactccttcatgaaattcaccattaaccgagctgcctttatcggccaactcaacaacgtcttacgggcggtttcttccaagtcaacgattccgattttgacgggcttaaagctggtcgtcgacaacaatgaggtcgtattaaccgggagtgacgccgacatcagcattgaaaccacgctaagtggcgcagacggtcagtaccaattgacggtagaagaaccaggcgccattgtgttgcccgcccgtttcttcagcgacatcgtcaagaagttaccggatcaacaagtaacaattgctgttacagatggttttcaagcccagattatgtccggaacggcggagttcgtcattaatggtcaagacgccaataactacccgcacctgccggaaattgacacggctgctagctttgaagtagcggcggacctatttgccgacgtaattcgccaaacccaaatcgccgtttctcaccaggaaagccggccaattttaaccgggatccacgtttctttagctgatgggattttaacggccgtggccacggatagccaccgcctttcccagcgcaaggttcgcttggaaaatgttggggagcgtcaagttgacgtggtcatccccggcacgtctttgacggaactatcgcggatgattggtgacgttaaggatccggttaagatccaagtgacggacaaccaggccctctttgtctttggtaacacccgcttttactcccgcctgttggaggggaactacccggacacgtcgcgcctaattccggacacgtctgaaacgacggtggaactggatgccagtgcctttttggcggcgattgaacgggcgtcgttgctttcccaccagagtagaaacaacgtcgttaagttgacggtcgacccgcaagcgggcctggccaaggtatctggtaactcggccgacatcgggaacgtggaagaaaacatagcgacggaccggatggaaggaagcgacttggaaatttcctttaaccccgactttatgggtgacgccctgaagtcctttggtcaggctaagattatcctgtcctttacgacggcgttgcggcctttcaccctggtgccaacggaagattccggtcaattcgtccaactgattacgccagtgcggacttactaaacttaaataacaaagcttgtgaaacggtcggcgagtttgccggccgtttttgtaattaaaattgaatatgggcgtttaaacgcgatttgagggcaaaaggtgatttttgccctcaaggggtcaaaaaagctcagaacggctctgaagggggaaagatttgtttttacccctcaaaaaagctataattgtactatcaaataaagtaggtgacgtgtgaacaaatggaaaaagaagtcaaaattgacgcacccttcattaccctaggtcagcttctaaaagaagagggcatcatcccaactgggggcgctgctaagtggttcttaaaggagcacgaagtcaaggtaaatggggagttagatgatcgccgggggaagaaactttaccccggcgatcacattgatgtcgtcggaattgagcaagttgttatcgcgaccaactaggagcagccgatgattctccaggagcttcagttaagtcattaccgtaactatgaggaactggcggtgacctttgcgccggggatcaacgtcttaattggagaaaacgcccaggggaaaaccaacctgctggaggccatctacctgttggccttcaccaagagtcaccggacggccaaggaccgggagttaattggctggcaccaaaagctggcccgggttagcggcgtggttgagcgagcgagcggccgccttcccttagaggtgcaaatttccaccagtggcaagcgggtaaaggtcaaccacctctttcaaaagcggctttccacttacgttgggaacctcaacgtagttttgtttgcccccgaagaccttgccctagttaagggggcaccggtgaaccggcgccagtttatggacatggaatttggccagatgagtagcaagtacttgtacaacgtcagccgcttcaaccagcagctcgcccaacgtaacgcctacttgcgccagttcaagtatggccaacaaagtgatcggattttactcggggtgatcacggatcaactcgcttcggtggggggcgatgtagtggtggctcgccaacagttagtcaagcggttgggaaagtgggcggctgaattacaccaccacatttccaagcaaaaagaagagctgagcttacagtacgttagccaagttgaagtggacgatcaaacgaccgaagaggaagcggtcgcccaactgcgccgcctctattcagaaaacgaggagcgagaaatcgagcacgggaccagcctgattggcccgcagcgcgatgacatccacttcatcgtcaacggtcaaaacgtgcaacgcttcggttcccaaggccaacagcggaccaccgctttggccgttaaattagccgagattgacctgatgaaagagcagaccggtgaataccccctgctcttgttagacgacgtcttgtccgagttagatgacgaccggcaaacccacttactgacggcgattcaagataaggtgcaaacctttatcaccactactagtttgagtggggtggctcggcaactaattcaccacccaaccatcttcacgattcaaagtggcacactcacaaaggaggaagactagtgacccaacaagaagaacaagcacgtaaagcggaactagctagcgaatacgacgccagccagatccaggtcttaaaggggttagaggccgtgcgtaagcggcccggtatgtacattggttccaccaccgtccagggactgcaccacttggtgtgggaaatcgtcgacaacgggatcgacgaagccctggccggtttttgtgatgaaatcaacgtaattgttgaaccggataactcgatcatcgtgaccgacaacgggcgggggatcccggtcgatatccaaaaggagaccggcaaacccgcgcttgaaacggtctttaccgtcctccacgccggtgggaagttcggtaacggcggttacaaggtttctgggggtctccacggggtaggggcctcggtcgtcaatgccctgtcaacggagctagacgtcaaggtcgcccgccaaggcaaggaatactacatggactttgcaaggggccacgtcaacaccgccatgaaggtgatcaaagacgacctgccgcaatcggcccacgggaccacggtgcatttcgtcccggacccggaaatcttccgggaaacgaccgtctacaacatcaacaccctgattgaccgcttgcgggaactagcctttttaaacaaggggcttaagatcacggtggaagaccgtcgggaaggcaaggagaaacaggaatccttccactacgaaggcgggattcgtcactacgttgaattcctcaatgagggccacgagctactctttgacccgccaatttacgtggagggggaatacaaggggatcacggtggaagtttccttgcaatacaccgatgactaccggtccaacctcttaaccttcactaacaacatccacacctacgaaggtgggacccacgagacgggctttaagaccgctttgacccgggtgattaatgattacgggcgtaagagcgggcaaatcaagggtaacgtcactctatccggggaagacgtgcgcgaaggcctgaccgccgtggtgtccatcaagcacccgaacccgcagtttgaggggcaaaccaagaccaagctgtctaactccgacgctagaacggcgactgaccacatcttcgccgaaacgatgacccgcttcatgatggaaaacccggacgtggcccgcaagatcgtcgaaaaggggatgctagcaagcaaggcccgcgacgccgctaagcgcgcccgggaagtgacccgtaagaagagcggcttggaaatctcgaacttaccaggaaagctggctgataacaccagcaaggacccggccatttccgagctcttcattgtcgaaggggactcggccggtgggagcgctaagcaggggcgttcccgcttgactcaagccatcttgccaatccgggggaagatcttaaacgtggaaaaggcctccttaaaccgggttttggccaacgaagaaatccgctccctgtttacggcactaggaactggctttggcgacgactttgacgtcaacaaggctaactaccacaagctgatcatcatgaccgatgccgacgtcgacggggcccacatccggaccctgttgttgaccctcttctaccgcttcatgcggccgatgatcgaaaagggctacgtttacatcgcccagccgccgctgtaccaagttcggcaagggaagtttgttaagtacatcgaaaatgacgaggaactagaacgggtggtcaactccctgcaaccaagccctaagccggttatccaacgctacaaggggctgggggaaatggacgccgaacaactttgggaaacgaccatggatccggctaaccggcacctgttgcgggtgaagttagacgatgccaaggccgccgatgaaattttccagatgctgatggggaccaaggtgggcccgcggcgggaattcatcgaagaaaacgccaccttcgtggaaaacttggacctgtaagaactgatattgaggaggaataagcgtgccagaacaagagatgcctggacggataaccgacgttaatctgaccagccaaatgcggaattcattcttggattacgccatgagtgtcatcgtctcccgggccctacctgacgttcgtgatggtttaaagccggttcagcgccggattttatacgggatgaacgaactgggggtcactccggataagccctacaagaagtcggcccggatcgtgggggacgtcatggggaaatttcacccccacggggactcttcgatttacgaggggctcgttcggatggcccaagacttctcctaccgttacatgctggtcgacgggcacggtaacttcggctccgtcgatggggacggggcggccgccatgcggtacaccgaagctaagatgagcaagatcgccgtcgaaatgctgcgcgacatcaacaaggacaccgttgatttccaagacaactacgacggtaccgaaaaagaaccggctgtcctgccggcccgcttcccgaacctcttggtgaacggggcctcggggattgccgtcgggatggctaccaacatcccaacccataacctgggcgaagtaatctcggcaattcacatgctgatgaataacccggacgtgacggttgccgagctgatgaaggccttaccaggaccggacttcccaaccgggggcgtagtcatgggtaaagcggggattcgccaggcctacgagagcggtcagggttcgattatcgtccgggccaaggtggaaattgaggagcaaaagaacggcaagcaacggatcgtcgttcacgaaattccgtacatggttaacaaggccaagctgatcgagcggatcgccaacctcgcccgggaaaaggaaatcgatgggattaccgatgtcaacgacgaaaccgaccgggaagggatgcggatcgtaattgacgttcgccgcgacgccagtgccgaggtgatcttaaacaacctctacaagatgaccctgatgcaaacgacttacaacttcaacatgttggcgatcgttaagggcgccccgaagatcctgtcattaaaagagatccttcagtactacttggaacaccaagaagaagtagttcgccgacggaccgaattcgacttgaaaaaggcccaaaaccgggcccacatcgtcgccgggttacggattgccttggatcacatcgacgcgatcatcaacatcatccggagctcggaaacttccgaactggctaagcaacggctgatggacgactacagcctgtccgatcgccaagcccaagccattttggacctgcggctggtacgcctgaccgggttggaacgcgaaaaaattgaagacgagtaccaaaaactagtggccgccattgcagattacaaggacatcttggcccaccaggaacggattaaccagatcatttacgatgaactgatggaaatccaaaacaagtttggtgacgagcgccggaccgaattacaagtcggcgacatttccaacatcgaagacgaagacctgatcgaagaagaagacatcatcgtcacactcacccacaatggttacgtcaagcgcttgccggttgacgaatttaaggcccagaaccgtgggggccgcggggtgaaggggatgggcgtccacagtgacgacttcatcgagcacctggtcgctagttccactcacgacctcttgctcttcttcaccaacaccgggaaggtctttgccatgaagggctacgaaattccagagtacggtcgggccgcccaggggattccgatcattaacctcctggacgtcgacggtaaggaaaaggtgaccgccgtgatcaacgttgcccaaagagaagacgacttacaaaaggacctcttctttgtgacccggcagggaacggttaagcgcacgccggtgacggaatttaagaacattcgctctaacgggatcaaggccattaacctgcacgagggtgatgaactgatcaacgtggcgattgtcgatgacgatcaaaacatgattctggggacccacctgggccacgccgccacctttaaggtgagtgccgttcggtcaatgggacgatccgccgccggggtccggggggcccgcctacgggacggtgactacctgattggtgccgcaccgttaaacgaggatgaccaggttctggttatctcggaaaagggctacggcaagaagacgccggccagcgagtacccaattaagggccggggtggcctggggatcaagaccgtcaacgtgaccgaaaagaacgggccactcgccgggttaaccaccgttcagggggacgaagacctgatggtggtgaccgataagggggtcatcatccgctttggcgttgaatccgtctcccaaaccaggcgcccagcaattggggtccacctgatcaagatggacgccgactcagtggtggccacgatgaccaaggtcgaaaaagagaccgcagaaacggatccaaccgaagcaagcgctgaagaagccgaaacgccggttgaaggtcccgacgaaatttaagtcaaccaccactgactaaagtcagtagcttgtgagcaagcacccttctgatgccggccaatatttattaaaacagtggccagtaattcggcgacggccaattcgttgccgtcgtccgaatcaatccggatcagactttttagtagttcaatcttttcttgtcgctgcatggcgcatccccccatcataaaaccccggtgccagaacgaatctgcccaccggggtgaaagcttgcgtcctcatctcgtaaacctaggttagcaaacccaaatgagaaaaaacaagcgtgtctttaatttatttttaatttaacgttgaccgcgatcggtcttgtcctttaatagggggacatacttggccaaggcggccaccaaggcgtcgacttctgccggcgtgttgtaaatgccaaaggagaagcggagggtttcccaaacccgcggactctcggcgccaaacatcgccactaacacgtgggaaggatccagggacccggacgtgcaagccgacccggcggccccgatgatcccttccaagtcgaggttggttaaaagggcgtcgttaggcacccccttaaaccacagcgataaaacttggggcgctgcgccttcatccaaactcccgttgacttcaaagtcgatcccagcgtcttttaacccatccaccagctggtgctttagggccacgtaggttgcgcggtgctcggccatcttctcttggtgcagttcgacagcccgggcaaagccggccaccgctggtacgttttcggtcccggcccggcgctttaactcctggtcgccgccgcgcactaaggacgggaagacgatcccgcggcgccggtacaagaaaccaaccatctttgggccgttgagcttgtggccggataccgacatcaagtcgatctggtccgtttggacgtccaacggcaaggtcccgtatgcttgaacggcgtcggtgtggaaccaggcgttggaatcggcgacaatttggccaatttcgtggattggcaagtggctgccgacctcattgttgacggtcatgatcgtgactagaatcgtgtcctcgcgcaaggcggccttcaagtcggctaagctaatctggccccgctcgtcgacgggcaggtaggtcacctcaaagccctcttgttccaagtcttctaggggccgcaagatcgcctcgtgttcaaaggcggtcgtaataatgtggcgcccctcactttggcgggccttggccacctgcttgacgaccgtgttatcactttcggtgccgccactggtgatcacaatttcatcgtcgaactgggcgttaatcgaccgggccaggaggtggcgtgaatcttccagcatctgtttagcctgacgcccgtagtagttggtcgtcgaggcgttcccccaagtcgtctccagcgcttcggtcatcgtttcaatgacctccggggccgtcttggtggtgccggcgttatcaatgtaaatccgcttatccaaaaaaatcgctcctcattttaaatattgctagccgaattcttaaccgttctagtatactacttatttttagatagagaaggggaaagcctttataaagcggtacaatacgaggacagtacaaacacaccgtgtgcagttggtgcttttctagccaacgaaccggttcgggtgcctttaaggtaccctttttttgtacccacaaagctaaatatcctgtcaataaattaccatcatggtagcccatcaacaggatttagtgtagagccagttttttggaatttcctgatcacaaaacggccgccggaccaacagtccagcagccgttcttaatctttataacggtaaatccttttggttaaaggcgaggttgccccccgcaaagcaaacggcgcctagcccgcctaaaatcgccagttttccttgccaagcatctccttgggccataacgtctttgtaatcaaacagcgatacaatcgtcaggtgttaaacgtcatccaacccactgaccccgtagttgacaaaagaagcaatcacggctaacaagatgaaagctaaaattaagacccccccggtccccagggatagcttagagaggttaaacacccccgaggctaaaaacatgattcccgcaaaggcaaaggcaattgccagggcgccgaagtttaattcaaccaaaattttctttgcaaaccccgcttctgcgtaatggttggccaacaaactggtcaccgtcatcgagccaaaggtcaccaccaacgcgccaataaagtacagcgtttgggtcagcgtgaccgttagccggcgaaccggcgccgtcaacaggtaggccatcgagccccggtcaacctggccggccagcagcttgttgccgacaatgataatgaaaatggcgctcaaggctggtaccagcatcccgtaaaacatcggtcctagcagggccctagtggcgctttaccaagggggtgtcgccgacgtgatgatgcccaccatggacggcttcacaatggttaaggaaatgcgggccgccgggtttgaacaacccgttttgatgctgacggccagaaccacaatcaccgataaaaccaccggcttcactagtgggaccgacgattacctcaccaaacccgttgacctagccgaactcaagctccgggtggccgcccttttgcgccgggctaagattaacagtgcccgccagattacaatcggtcagactattcttaacgaagagaattttactttgaccatcaatggccactccaccaccctagccaaaaaggagtttttgcttctcttcaccttgctttcctaccccaataaaattttcacccaggcccagttactcgaccagatctggggaattgattcggcctcaacggaagacaccgtcaaaacccacgtctcaaaggtttgcaagttacttaaggatagtaacgacgtgaaaatcaccaccatccgtggcctcggctacaagggagaaatttgtcatgactaaaaatccctttacccgggtcctcacctggctagttgttttgatcgcttttttgatcgtgatggaaaccctggcctttgactttgctttaatgctaacctttccccacctggcccgcaatttcgacccgcttaacccagtgctggcccttggccccaccgtggttatcttaacggtggtcttagccctaaccttttcttggctcaacaaaaaaatcacctacttaacaaagggtattgaccaagtggccgccgggaattttgctgcccacctcgatgagcaaaagggtggtcccctgtcagccagctaccagaacttcaaccaaatgactgaccaactcgctaaaaccgccactttgcgcaacgactttatcaaccagttctcccacgaatttcgcaccccgatcgcctcaatccaggggtttgccgacctaatgcaagaacgggagctaccaaaaaaagagcggcaagcctacctggctttgattagtaaggaggcccatcgtttaacgaacctgtctaccaacgtactgaccctaaccacgttagagagtcaaaccattttaaacaaccagacttcgtttgacctaactgagcaagttcgtcagactgtcatcctcctgtggccccaattagaagaacacaagcttaacgttgacctaacgcttgctccggcaaccgcatttgggaacgctgacctgttgaaccaggtctgggtcaacctaatcaataatgccatcaaattcacaccagacggggggcacctaacgattaaaatcgagcgccacgacgatcagatagccgtgtccgttaacaacgacggtcccctgatctcacccactgaccaggaccatctgtttgaaaaattttaccaagccgataatcgttccaacgtcggcaggcttgggcttggcctcgccattgccagccgaattattgctctccatcagggacgcatcaccgtggtttcgaatcctgctgaccataccaccttcaccgtctacctacctagcaaagggtcagccaagtagttagaagaacctttttaattgtaatataattaaaatagttaaatgttatgagggattttaatggcaactacgctcgtcttgtacttttcagcatccggcaccaccaaacggatggcccaaacgattgccaacttaaccggggccgaccttcacgaaatcaaggcccaatacccatacacccaagcggacctggactggcatgcccctcagtcacggacctcaattgagcaacatgaacaccaggggcacgtcgcctgcgtcaatgactttccggcccttgatcaatacgacacgatcatcatcggccacccaatttggtggggaattccgccccgtttgattgctaacgccattgaccaacttcctttagatggcaaaacgctggccacctttgccacctcggggggctccggttatcagcgcagtcaaagatatatccaacgcgtcgttgatcaaacccaccaccaggtgacgatcatccccggcactgtgttgagcaaccagcgccaggcgaagcagtggctgaccaaggcgaacttaatttagttggtagccggagcggttatttctaagggcgccgctcattttcagaaaagcccttaccaaaaaatcctttacaagtgaaccgtttcccagcataatgtagtcaattaaataaataatttcttcggggcagggtgaaaatcccgaccgacggtgacaagcaatgcttgaagtccgtgacccgcaaatttgcggctgaaccagtgcgattctggtaccgacagtgaaagtctggatgggagaagaaaaggcagggggaagtcccttgccacctttttgaacacgctttcaaccaggggtcccggaatttttccggggccccttttaaatttcccggggaaatgggaatggcaacctcctcggcgggccgaggaggttggttcccactcacctatgaaaggaagtcattaccttgagttcagacgaacagttcatgcaactggcgctcgctgaagcggccaagggcgggagcgccacctggaagaacccccaggtcggcgccgtgatagtcaaagacggccagctgctggcgacgggctaccaccaccagtatggtcaggcccacgccgagcgcgacgccatcagtaagctttctaacgaacagctggccggggccacgatttacgtcaccctggagccctgctttcactacggcaagcagcctccgtgtatccagttgttaattgacagccactttgcccgggtggtcgtcgccacgattgacccccaccaagtcgttggtggcaagggaatcgcccagctaaaggcggccggaattgatgtggaggtcgggctcttaaaggaccaagccgaggccctcaaccgccactacttctacttttaccgccagcagcggccctggatcacggccaagcaggccctctccttggatggccaggttgcagccgccccggggcaagcgacggcgatcactaaccaggccgcccgccggctggtccaccaggaacgcgctgactaccacgcgatcgtggtcggcgccggcaccgtgcttgtcgacgacccacgcctgctgtgcgagacgccgcaactcttccccccggtccgggtaatcttggaccgggcggggcgcctgctcgattaccaggaccgctttgtcttcaccgatgcttccgccccaacctggttagtcaccaccaaccgggccgccacgaaagtcgactggcccgctcacgtgaccgttaaactgttgcaaaacggcgactggccggagttacttgactactttaaagaagccgagttgcaaagcctctacgtggagggcggtcccgcggttttgaccgaactatttcaagcggtcccggtcaaccagttaatcacctacctggacccccaaatcatcggcgaccaaggcctggccggggcccagttcccggccggcaccgcttttacccaccgcaccgtcacccaactcggtgatgacatccggattgacgaaaggaatgacgagtaatgttctctggcttagtaaacggaacgggcaagctcacccagattgagcaaaccgaccacaccatccgcctaacgatcgacctcgaccccgccctgcaagagggaatggaagttggggcgtcgttagctgtcaacggaacctgcctgacggtcgagaccgaacaacccggccgcctaaccgtcaccctgatgccgcagacttacaacctgaccaccttcaaggacctgccagttggtgccctggtcaacttggagcgctcgctaaagatcggcgaccggctggagggccacatcgtcaccggccacgtcgaccaaacggctccggtcatcaaacgggaggttaacgaaaacgcaattgaattgacctttaagctccctgaagagttgcggggtcaagtcattagccaggggagcgtggcgatcaacggggtcagcttgacggtcatgaagcaagcagacgactggttctcggtcggcctgatcccccacacccagaccgttaccaacctggatcaacttagggttggcgacctagtcaacttagaaaccgacgtattaggcaagtacgttgccgcacagttaggaggcatttcaaatggacgttcataagattcaagcggcccttacccaccttaaaaacgggggcctgatcatcatgaccgacgacgaagaccgcgaggcagaaggtgacctgttaggaatcgccagccaggtcaccccggcgacggtcaacttcatgaccaagcacgcccgcggcctgctctgtgccccggttagcgaagcgatcgccaagcaactgggcctggatttaatggtccaagacaacaccgagccctaccacaccgcttttacggtttccctagaccacaagtcgaccagcaccggaatctcggcctatgaccgggccgccaccatcaaggccctggccgaccccaccagcacccacgatgacttttactaccccggccacatcttcccgctgatcgccaaggagaacggcatcttggcccgtaacggccacaccgaagccgccgtcgacctggccgagttggctggtgagcctggtgccggctacatctgcgaaattctcgacgccgacggccacatggcccggcgcccggtcttagagaagatggctgaggaactgcggttgccgatcctgaccgtcaaagaactgcaagagtaccggcgttcggtggtcagccaaccggtcccgccggtccacctgcccagcgcgtacggcgactttaccctacgccactttgacgacggcaacctggccctgatcaagggggacccgaccacgactaccccgttggtccgggtccactccgagtgcttcaccggcgacgtcttgggctccctgcggtgcgactgcgggccccaactccacgccgccatggaggccatcgaccaggccggcaccgggatcctgatctacctacgccaagaagggcgcgggatcggtttgccaaacaagctacgggcctaccgcctgcaagaagaaggcttcgacaccgtggaagccaaccaccaactgggctttgccgccgacgaacggacctacgaggccgctagccacatcctaagggcgctccacgtttcaaccatcaaactcctgaccaacagccccgataagatcagtcaactggaagaagccgggatcacggtcgcagcccgggtgccgctggaaatgccggcgaccgcctacgaccgcgcctacctcaagaccaagcaagaaaagatgcaccacctactcaaactcacggaggaagaacaacatgcctaaccaattcgaaggaaactttatcaccacccccaccaagaagatcgcgatcgtcgttggtaaattcaacgaatccgtcacccgcaacctagccgacggggcgatccggaccctaaagcaattcgggatcaaggacgaccaaattgacctcgtctgggtgccaggcgcctttgaaatcgcctttgccgccaagaaactggtcgccagcggccgctacgccggggtgatgaccttgggcgccgtgatcaagggcgaaaccgaccactacgacctgatctgccagtccaccaccagcgcaatcatgaacttaaatgctcagggcacgattccggtgaccttcgggattttgaccaccgacacgatcgaacaggcgatgcaacgggccggcttaaaggtcggcaacgagggttcgatgactgcccaatcgctgctggaaatgattagcttaaacgaacaactagggtaacgaaaaccaaagcaaaaccggccactccgcttaagtgcgaagtgaccggttttacttttgctttggtggcgagctggccgatggacacccgacaaatctgcgaatttgcgcaagataacgtgctcctctaacttgcgcaaatctaaatatttgtccggtcttagtttggagtttcttgtttttccggcgggaagttaagcaaggaaaggtctaattggttaaacacgtctcggatcgaataagtggccagtttatccaacgccgctcgctggacctggtcaaaaattaggtccaacgcgtcgggcatcccctccccgatccggcactccgtattagtttcattgttgaagtgcaataagtccccgccgtcaacggcctggtaaatggtcgccaaatctaattcagcgggatctttaactaactggggacaaacgtggccggggacactgtccaaaatgtggtgccgcttaagctgagccataatttggcggacctgggtctgatttttatttagggacttggcaatcgccgcactcgataggtccccgtcgctgccgcccgccgcaataaagactacgatatgaattgcatcgctaaacctggtggaatacttcattcttttccccccttcctgcaagtatcatcttcttatcttaccgcgctttgctcggcctggccatcaaacgcgctaattgggccaagtttgttttcaaatccccctggatcacggccgtgcggggttggaggttaaagggaaccgggcccggcttttggttgagcaccacgtagttccactcgctaaactggcggagcaagctttccacaggctttttgactagtgggttctgatcaccaacccccagttccaaaaccgccagtggttgatcggcatgcgccctgaccaacttgtttaaccccgccacctgttgggaatctagttgtggctttggcgcaaacattagcggcgttagcacctccccacaggtcgtacaccgtggcaagtctgcttcggtcagctcccgttcttgttcgagtccaaccattaacctggccgccgcccgtaggtcaacgtgagggtgatcaggggtctgacaacttccatacacccagttggcctcgttttcgaccacgtgatctaaaccggctaggttaaaatgatgttccggattcgtggtccagatgtaataagggcgccccttgataatctgacgtaagttttccatcaacgggctggtgtggtagtggctggagtaacgattaattatccgggcccaaacccgccactgcaccaccttactctggtacgggtattggacggcttctaacatgttatggaggccgtattggtcaaccaagtcgcccaataagtcatgaaagacagcgtcacttgcaaaccagttgaagccctcgctaatcgaaaacccattggctgccgtaattaacaaggccggggcctgttcaagcattccaagggcttgttgttcaggctcttgctttggtaccctcggtgttttcaagtaactttggtgactaaccgggttttgactttttagtttttgtaccgcccgcaaggcctgatcaacgtcggcgtcgatcaacaccgaccggcttgcaatctgggtatgggtcatggcgtcttggggattaatgttaacgtagtgggccaaggggagctgactggttaactgccaaaagggttcttgaataaacatcggcgtcattcgccccactcccagctcaaagaataacaacttttggttgccaaaccggttgatgaattggcgggtcttttcgtgttcttgtttaaaccggcgcccctccaaaaattctggtgaccgcacccacggcgttagcggcaagccagttgtcgggctgtggggaatcaaatcgtctggcaagtacaacttatcttcttgttgcgccaagtattccatcccccgcttaacaaagggccgggcgtcgtaaagctggtcgtcaatctgcggggcgctagactgcaagaagcgccaatccccttgaatcgtactgatttgctcgtcggcaaagtagcggttaaacattgcgtcttggttcgtggtcaagatgtggtaggggcggtcttgaattaggtcctttaaaacttggtaggtattcttgaccggcggctggtggtagataaagtccaacatccgtaccaggtaggcccagcgctcattttcgctcgtaaaccgcgcataaaagcccttgaagatcccggtcgcctccgggtggcgggcataaaagtccccgaagtgctgcttgtataccgggctggcctggtaccaccagtccatcccagcggccgcagacattcccgatccggcgccgattaagattgcatcactatcaagcagaacgtcctttaactgttcgatctcgttcttcatgcttctctccttgctgttaaattataaataactttacccacccattctaaatggttgttaattataaatcaacttcaaaggcgtcccacctaaaaatccccgcggttcgccttggcataccacggggatttatttttaattactgttttggccgatccagcaagcggacccggctgacggcgtcaatctgattgagggtggtcgttagaatctcggtttgttcggcggtcaattcgccgacgtcgaccatcgtgtaggcgtactcgcccttggcccggttgaccaggttgtcgatgttgacctcggccttggcgatcgccgtcgaaatttgccctaacatgttggggatgttgcggtgaatgatcgtgaagcggtgctggctggtgaacggggccaccacgtccggcaggttcacggcgttggtcgtgttcccggtctccaaatactgggtcagttcgtcgacggccatcttggcgcagttgatttcggcttccttggtcgagccccccaggtgcggggtaatcgtgaccttcgggttgtcctgcaggcagtcctcgccgaagtcggtaacgtactggcccagttgaccattggccagggcggccacggcggcctggttgtcgacaatccccagccgcgagtagttaaacaggatggcgcccggcttaacctgggcgagcagttcctggttaatcatcccggtcgtttcctcgcttttcggcacgtggacggtgatgaagtcggcccccttgaccgcgtcagccagggtggcggcccgttgcacccgggcggtcaagttccatgcggcgtccaccgacaggtaggggtcgtagccaatcacgtccatccccaggtcaatggcggcgttagcgaccaaggaaccgacgtggcccatcccaatcacggccaggcgcttgccgaagagttcgtggccgttgaagcgcgacttttcgcgttcggtgcgcagggagatgtcttcgccaacgttttgggcgctccagttggccgcttcgatcaggttccggttggcgatgaccatcagggcgatgaccacttccttcaccgcgttggcgttaccgcccggggtgttgaaaacggcgatcccctgttcggagcaggcgtcgagcggaatgttgttaaagccggccccgcagcgggcgatcgctagcagctccggttcaaattggtagtcgtgcaggtcgatgctgcggatcatgtaggcgtccggttcctgaccggtgttgacctggtagttttccttaaaggtgtctaagccttccttggcgatcgcgttgtaggttttgatttgatacatgtgcgtccctcctaaatttcttgttcaaactggtgcatgaagtcacgcagggccacggccccggccagtggcatggcgttatacaggctggcccgcatcccgccgactaagcggtggccctttaagttcaccaacccggccgcggcggcttccttgatgaagcgctggtcaaggtcggcttgcccagtggtgaagggaatgttggtcaggctccttgaatccggcgccacccggttagagaagagcttggactggtctaagtaatcgtaaaccaggccggccttttggcggtttaactcgtccatggcctggaccccgccctgttcttttaaccacttcaagaccaggttggcgaagtaaatttgaaagaccggcggcgtgttaagggccgattccttcttggccagggccgggtaattgagcatgcttggcaggccgtggtcttccgttaggtagtcatttttgaccaccacgatcgtcaccccggccggggccaggttcttctgggcgccggcgtagattaggtcaaaggaagaaaagtcgtaggcctggcccaagaagttggaggacaggtccccgaccagcggcaccgccgtttgcggcaggtcctggtaagccagccccatgatcgtgttgttggtggtgatgtgaaggtagtcgtaggtgtcagctggtaggtctggcaccgccggaatgtgggcgaagtccggtccggcctcggtgaccacgtcaaccgtcaagtccggcaacttcttcgcctcttcaatcgcccgggccgaccagtgcccggtatcggcgtaggccacccggtggtggtcacgggccaggtttaagggcaccatcgtaaactggagggtccccccaccctgcaagaagagcggtgtgtactcgtcggcgctcagccccatcaactgcaagagccgttccttggcctgctggtagatttctcgaaagaccggcgagcggtgggagatttctaggatgcttacttggctaccctggtaatccaggagctctcgttggacttgttctagcaccggccggggtaaggtggctgggccagcggcgaagttgtaggttggcatggcaattcctccttgattccaaatgaaaaaaacgggcccccacctcttttggtgggggcccgtttgtaccacggtaccaaggtcagcccccaccaggtgaaggccaaccctaaaggacggccttcgttagcgtgaagaccgtgatgaggaaactaagttgtagcgattgaattgtaacatctgggtttcctcctttgttcgttcctttaagttaagtaaattctaagggaactctcatcaaatgtcaatcatcaatttgttaattagtccacttggtgtgggtgtcccggttatagccgacctgacggttttcgacctcgaccgtcccccggtggccgtggatcgtcaactcgttcagggcggtgtcgagccgttgcatttcgaccggggccaaatcaacctgagccgccgctaagttttccaagatccgcgcccggttcttggagcccgggatcggcaccacgttggggtacttagccagcatccaagctaacgaaagttgggcggtcgtcacccccttggcctcggcgaactggttgagtaagtggatgaccggttggtttttatccatgttttcctggctgagttggggcacccagttccggacgtcatccgctttttcaaactggctggtactgtgcagttggccagataaaaagccgctggcaattggcgagaagggcaccagcccgatcccgttttctaagcagtagggctggatcgtttgctcgcagtcacgttccagcatgttatagaggttttggacggccgagactggcgtcacctggtcggcttcttttaagaggtccaaggagacttgcgacagcccccagccccggatcaggccctggtcgattaacttgcccatcgccagcgacacgtcactgagggccacgtcctcgttgacccggtggaggtagtagaggtcaacgtagtcggtctgcaggttttccattgacagggctaagtgatggcgcagcgccccttcgacgccgtattcggccacctcttctggttcaatccggaccttggtggctaagactacctggtcgcggaaggggtgaacggcctcacccaccagttgttcattgtggccggggaagaagcgctccttgccgtagccctcggcggtgttaaagaaggtgcaccccgcctggtaggccgcccggatggaatcaactgcttcgtcatggtcgggcaccgttccgtagccgtgagaaaagcccatgcagcccatcccgacgtctgaaaccgcgattttacgtaagtaacgtgtcatcaaaatccctccttttgatgaccagaatacgctttcttacccgaattggcgacaatctttgctataatctttgaaaaagaacggaggatttctcatgactgaactttacattatccgccacgggcaaacggctgccaacgtcgccgggctcaagcaggggacgatcgacgacgagcgtacctacctgtctgaaacggggatcgcccaggccaaggaactggccggcgccttggacctgactggttttgccgccctctaccactcccctctgcaccggacggttgaaacggcgcagattgttaaccaaacggcccacctgccaatggtcgccgacgaccgcttgctcgaaatttcctacggcgattgggacggccagttaaacgccgacctgatgactaagtacccggacctctttgatcccctaatcaacgacgtccgggccgcctacgccccggtcgctaacggggaaagctttgccagcgtcgaagcccgggtgcaagccttcaccgaagaggtcgctaaggcccaccctgacgaacgagtcgccgtcgtcacccacggcttcaccgtccgctcctttgccattaacgccacccagtcgcacgacctgacgattttagaacccgccaactgcagcgtcaccaaaatcctagttgaccccactagcggcgaccagcacctagtttactataaccgcagcgccagcccggccttttagcgccgtgctaaaatgggggcgagaggagataatttatgaagcaacaacaattgatcggcgccctattgcttagcggattcctgcttggcataaccgggtgcggtcaggtcaaaagcaagcggtctagtcaagcctcaagtagccacagtagccaacaacgggccgctgctatcacttcggctagcttaacgtccaccggtgcatcccccacggtcagcgccccttttgcgaccgcctcggcggcggggatcactgcgcccaccacccagcccagtaacgccagccaaagcagtagccagtccggggtcgtcgtccacaacgccgaagaagccctggcgctggccgaatcgatctacggggatgataacggcgactaccagtgggtcatcatgagccaatcggatgggcaaccggcccaaaacgaggacggcagctacttcgtcaaggcaatttccaaacaagcgatggtcgagggctcgatgaccgggaccgcgctgagcctccgggtctaccccaacggaacaattataagcaactagcagttttacccaaaaatatcataatattttatggtgatgtgtgcgacttaatagacatctttagcggcgaatataacgtcattttccttaattacaaaaaggaataacccgtttgtctttggtaaacaagtagtttataaaccataaataaataaattaattatcaacaataaaaatcattacatttccctggttttactttttaattatttgtgataatataatttgtagagtgatagtgattctcccaatcttgctacactccgtatgataacctaacatactccgagaggaggagcccgaccttggctcctccttttggtttttataagaaaacaaaacgcctcgcgccgcattttgcgacgtggggcgtttttgcgtgctaggttacacagataacatgctccccaaccgcaggcctagtggctaagtacgggcaatgaacgatgcttatcgcatcaacccttgccctagcttagcccacggcctgctttatggttgggtcgcacttcttaattatcaatctcttcatccgtctgcaggacggccatgaaggcggcctgcggcacttcaaccttgccgacggccttcatccgcttcttcccgcgcttttgcttatccaagagcttggcccgccggtcggggtccccagtgtggatccgggcggtcacgtccttgcggtaggccttgatgttggtccgggcgatgatcttggaaccaattgcggcctgaaccgggatttcgaagttttgccgcgggatgatcttcttgagcttggaggcaatctcgcggccccgttcctcggcaaagtcgcggtgggaaatgaagctcaaggcgtcgacgcggtccccattcaagaggatgtcgatcttgaccaggtcggacggccggtaatcgtcgatctcgtagtccaaggaggcgtaaccacgcgtcgaggacttgaggcggtcaaagaagtcgtagatgatttccgacagcgggatgtggtagatcacgttgacccgggtgtcagacaggtattccatcgtgtcgaactggccccgcttgcgttggcacagctccatcacggcgccgacgtaatcgttaggtaccatgatcgaggccttgacgaatggttcttcgatcgacttgatctcggtgacgtccggcatttcggccgggttttcgacgtttttggttgacccgtcgtgcaagttgacgtgataggtcaccgacggggcggtggtgattaaatcaaggtcaaactcgcgctccaagcgttcttgaatcacgtccatgtgcaacatcccgaggaaaccacagcggaacccgaagcccagggcctgggagctttccggctcgaaggtcagggcggcgtcgtttaactggagcttttctaaggcgtcacgcaggtcgttaaacttggcgttgtcggtcgggtacagcccggcgtagaccattggctgcatctggcggtaaccggccaggggcttatcggtcgggtggttggcgtcggtgatcgtgtccccgacccgggcgtccttgatgtccttaatggcggcggtcacgtaaccaacgtcgccggccatcaagaagtcgcgggccagcggtttgggcgagttgatgccgacttcggccacttcgtaaaccgcctttgagttcataaactcgatcttatcgcccttcttgacggtcccctccttgacccgcacggacaagaccaccccgcggtagtcatcgtacttggagtcaaagatcagggccttgagcggcgcctctaaatcgccggtcggcgccgggatgtcttggacgatcttttctaagacctggtcgacgttgaccccggtcttagccgagatgtcgacggcctcgtcggtgtctaagccaatttcgtcttcgatctgctttttggtcccctccggatcagcggacggcaggtcaaccttgttgatgaccggcaggatctccaggtcattatcgatcgccaggtaggtgttggctaaggtctgggcctcgaccccctgggtggcgtcgacgaccaaaatcgccccttcacaggcggccaaggagcgcgacacctcgtaggagaagtcgacgtgacccggggtgtcaattaggtggaaaatataatcctggccgtcctgggcgtggtaagtcagggcgacggcgtttaacttaatcgtgattccgcgttcccgttccaggggcatgtcgtctaagatctggtttttcatttcgcgcttgctgatcgtgtcggtcatttctaaaatccggtcggccagcgtcgatttcccgtggtcgatgtgggccacgatcgaaaagttgcgaattcgctgttggcgttccttcattgctgctaaatccatgcactatgcctactttcttccgtaaagtctgcttctagtatagcaaagaccgcccgccggcgccaaattatgcttgttgcttgagccaatcggccaccagggcctgcatgacggtggtgtcttctgcgggcccaatcgtcaggcgcagccagtccggttgcaagtggcgccggacctggaagcccttctccaacagggtttgggccaggtcagcggcgtttttgaccgtgaagtaaatgaagttggcctgactcttaaagtacttaaccccctgctggtcaaagaagtcttcccacttggcccgctcaaccgcattcttggcggccgcttccttgacgaagtcctggtcccttaaagcggccacggccgctacctgggccagggtgttgaggttgtaagggagccggatcttttgcaaaatcgccgccaatgcgaccggcatcacggcaaagccgacccggacgttggccaacccgtaggccttagaaagggtccttaaaaccgccacgttttggtaccgcttgaccagcggcaggcaggtcgccttggccgggtcgtcagcgaagtccaagtaggcctcgtcaatgaacaccagggtgtctttagggacttggcgcacgaagtcctcaatcgcctgggggctttccaagaccccggtcgggttattggggttgcagatcaaaaccaaccgggtcgcctcgttaatcacggccagggcgccggcaaagtcgaagtggccggtcgccgggttaacgggcacctccttgacggccgccccctcaaccgtggcgtgcagtgcgtactcggaaaaggcgggcttggcgaccaccacctgatcgtccggggtcaaaaaggcgcgggccaccaattcgatgatttcgtcgaggccgacgccaaagaccagctggtcgccggcaacgtttaactgctggccgaccagggcccgtaactcgctggcgtctccgtctgggtaacggttgagcgccccgtcgttaatcgcattgatcagggcctctttaaccaacggcgaggtcccgtacgggttttcgttggccgacaggcgggccaggcgctttaagtggtacttgcttttaacccgttgaaccggttcttctggcacgtagctttgaatttggttgatccctgctttcattcccctacccccttataagtccttaatctccgggcggtccttgaagtcgctcatcaagccctcgcgcttgcctagctcctctttgatgtcatcgtaggtcagcccctgttcaacgagcaggaccatcaggtggtacaagaggtcggccgtttcgtactggagctcggcggtgccttcgtttttggcggccacaatcacctcggtggtttcctcgccgaccttctttaaaatcttgtctaaccccttagtgaagaggtaatcggtgtacgacccctccttggggttggcctttctggcggcgaccatttggtataagctttctaaatcttgcatcttaatcttcctttccctgcacctggttgaaaaaacaagaccgtgccccggtgtggcaagccgggccggccgggtccactttgaccaagagggtatcttggtcgcagtccaaccacatttccttgacgacctgggtgttgccagaagtcgcccccttgtgccagagtccctggcgtgaacgtgaccaaaaccaggtctccccggtttgcttggtcagccggtagctcgcttcgttcatccaggcgaccattaacacgtccttggtggttgcgtccaccaccaccgtcgttaagagcccctttgtaaagtctggttccaccggaccggcaccccctttttaatcaggtcctctttgacctgggcaatcgttagctgctgaaagtgaaagacggaagcggccagggccccggtgacccccgagttcaaaaagacgtcggcaaagtcatcgatcttcccggcccccccggaggcgatcaccggcacgtcgacggccgccgttagttccttgtaaaaggcggtgtcgtaaccatcctgggtgccgtccttgtccatcgaagtgaccaggagctcccccgagcccagggaaacgacctgcttggcccaggcaagcgcctcgaggccggtgggcttggttcccccgtgggtgtaaaccatcttttgcccggtcgccgggtcggttttgacgtcaatggcggtgacgagacactggttaccaaacaggcgggcgcccgcactgatcaggtccggatcggccacggccgaggagtttaaagaaaccttatcggccccggccaacaggagggcccgcatgtcttcaactgagcggatcccaccgccgaccgttagcggcataaagacctgttgagaaatggcctcgaccatatccagcaatttctggccaccgccggcctacttgggatccgtgatgaaaaccaggccgtccgtaccgttttcctggtacttaaaggccagctcgaccgggtcgccaacgtccaatagtcgctcgctgcccagtaggcgctttttgacccgaccatcaatcacgtttaagcacggcaaaatccacctcgtcagcatctgcttcacctcccctacttacgtaactcaccttgccaccactccttcgagaaagtcatttaataaattcaagcccattggcccgctcttttcggcttgaaactgcatcccgaccacgttgccccggtgaacgatcgtcgggatgactaccccgtattcggccgtggcgacaatgttttggggcgccgtttggacgtaataagagtggacaaagtaggtgtactcctcatcaatttagttaaagcggctgaccgggtttccagccggttcatgttccagccgacaatcggcaccggcagttgcggggtgctcgggatttcggtcacccggcccttaattaagcccaggccgggaattaaaccgccctccgttgagtaatcaaatagcaactccatgtcgagcccgatccccagtaagggaaccccctgttccaccgcccgccggatgggtccgatcaggtggcgttgcatgaagttggtcatcccggactggtaggtgccgatcccggttaaaatgattccatcgctagaaacaacttgtttggcgtcgttggtcaataccgtctttgctcccaattaggcaaacgccttttggacactatgagcattgcccgcgccgtaatcaataagtgcaagcattggccctctatcgacccccacccgggccgactcctttcttctcttttgtgtgcatttctcccgtgtagccgattagtaacaaaaagcccccctgcatgataagcaaggggactcccgagtacggtttgcccgaaccccgctcgtggtggggttcttccttgctgattggggacgccatcgctaaccccagccctacttcagccgttgctcatcgtctacatattctctatccaaataataacccaaaaccgcttaattagcaaaaattattgtgcaaacaaaacaaaaagcgcccttttagagcgcctttattaaacaattaatgatcgaaagctaaccatcttatttattatcttcgaaggcatccttaagcttatcaaaaaatcccgctttgacgcccttcacgtcttcaccagaggccgccgcaaaggccagcatcgcctcgcgttggcgcttgttcaaggtctttggcgttttaacgtgaacggtgacgtattcatcgccattcccgttaccgttgacccgcggaacccccttgccacgcaggcggaacttggtttccgactgggtcccggccgggatcttcaagtcaacgtcgccgtgaacggtcttggcttgaacgtggtcccccagggtcgcctgggaaatcgagatgtcttggtcgacgtagatcgtgttgccatcccgcttgaagtcgcggctcggcgtgacccggaagacgatgtacaagtcaccgtatgggccgccgttcttgccggcttccccttggccctgcagacgcatctgctgaccatcgtcaattccttgcggcaccttcaccttgagttcgtgccgttcctcggttaccccggcaccgtgacaggtgtcacactggtcggccgggtcgatcacttggcccttaccgccacaggttgggcagacttcttgggactgcatcatccccatcatcgtttgccgttgccgaaggacgtacccttggccgtgacaagtggaacaggtgtgggcggacttgcccggcttagcccccgacccgtgacaggtgtggcactcggcggaccggttgtacttaatcgaagtctccttaccaaagacggcatccatgaagtcaagggtcatcgtgtactggaggtcgcgcccttgttgtggtgcggacggatcacgccgggcccggcccccaccaaagatgtcaccaaagatatcggagaagtcaccaaaaccaccctggctgaagccgccctggccaaagccaccgaagccaccttgaccgccaaaaccgcccgcttgggagccggtcgtgccaaactggtcgtattgggcccgcttttggtcgtcactcaaggtttcgtaggcctcgtttatctttttaaactttttttcggcgcccggctcgtggtttacgtccgggtggtacttggccgccaacttccggtaggcccgcttaatttcggcctccgaggcgtcctttttgacaccgagaacgtcgtataaatcttcttctgccatgaatacctctcactaaattttgtaggttattatcgcacagttcaccatagcaagcaaaagccaaagtccggtttcctggcctttggcttcttgctcaattataggacctaattacttcttgtcgtcggggttaacttcttcaaagtccccgtcaacggtgttgtcgtcgtccttcttgccgtcaccttggtcgccagttggttggccaccgtcagcttggttttcttgttgggcttgttggtacaacttaacggtcaggtcttgaacgatcttgtttaagtcatcctttttggccttcatgtcctctaagttgttgtcgtccttcgccttttgcagggcgtccttggcgtcttgggccttcttgatttcgtcgtcagaaaccttccccttgagttcttctaaggtcttgtcggtttggaagaggagttggtcggtttcgttacgtacatcggcttcttccttcttcttcttgtcggcttcggcgttggcttcggcgtcctttttcatccgttcaatttcttcgtcggacaaaccagagttggacttgatggtgatgttttgcttcttgtgggtcccttggtcttcggcagaaacgttgacgatcccgttcttgtcgatgtcaaaggttaccttgatttgcggaacaccacgtggtgcaggcggaatgtccgtcagttggaagttcccgagcgtcttgttgtcggcggccattgggcgttcaccctggaggacgtgaatgtcaacggctggttggttgtccgcggccgtggagaagacttggctcttggaagttgggatggtggtgttgcggtcgatcagcttagtgaagacgccccccatcgtttcaatcccgagggacagcggcgtcacgtcgaggagaacgacgtccttaacgtcaccggttaagaccccaccttggatggcggccccgagggcaacggcttcgtccgggttgattgagtggtttggttccttaccggtcaaggacttcaccatttcttgaacggccgggatccgggtggaaccaccgtttaagatcacttcgtcaatgtctgagaagctgagttcggcgtcctttaaggcgtttagaaccggttgcttagtccgttcaaccaggtcgttagtcaattggttgaattgggcccgggttaaggtcttttccaagtggagcggaccgttgtcgccggacgtgatgaacggcagggagatttgggcttcttgaaccccggaaacgtccttcttggccttttcagcggcgtccttgagccgttgaagggccatcttgtcttgggacaggtcgatgccgttttcttgcttgaaaccgtcaatcagccagtccatgatcttttggtcgaagtcgtcccccccgaggtgggtgtccccgttagtagagagcacttggaagaccccatccccgagttcgaggatcgaaacgtcgaaggtcccaccaccaaggtcgtaaaccaggatcttttcgtccctgtccttcttgtccagcccgtaagccaacgaagaagcggttggttcgttgatgatccgcttaacgtctaaaccggcgatcttcccggcgtccttggtagcttgacgttgggcgtcgttgaagtaagccggcaccgtgatcacggcttcggtcaccgtgtcaccgatgtagtcttcggcgtacttcttgatgtattgtaaaatcatggccgaaatttcttgcggcgtgtacttcttgccttcgatatcaacggtgtagccggcttcacccatgtggctcttgatcgacttgaccgtgttcgggttggtgattgcttggcgcttggccacttccccaacttgaacttcaccgttcttaaaggaaacaacggacggcgtggtccggcccccttctgggttggtgataatctttggttcgttaccttccatcacggcaacggcggagttagtagtaccgagatcgataccaataatcttgttacttgccatacttaaatccctcttttaattattaattttcagtttgttactgggctacgatcaccatggctgggcgcaggacccggtcatgcaagacgtaaccggcctggagcacctgcacaacggtgtccggcttttgatcaccactagcagcgacggtttgcaccgcttgttgcgtggtcggatcaaagggtcggtttaacgcttcaacttctttgatgtcgtggtcggctaaggccttttccaggtggtcgtgtaccatttggatccccttcttgagttgttgaccgttttcgtcttcaacttcaatttccagggcccgctttaagttgtccaaaaccggcaaaatgcccttggccaggtcctgaccatcgtacttgagcagttgcgcctgttcctttttaaagcgcttggtcatgttttgcatttcggcttgggcccgcaggttctggtccttttggtcatccagttgcttggttaattcttcaacttgcttttgcaaatcggtaactttttcggtctccccggccttagccgccggttccttgtccgacgtccgttcctgcttagcctttacttccccctcgtttggggctgcggaagcttgggtgttcttttcctcatcttttgccatttaatccctcctaggagtcgtaatagcggcggtagtggtcaagtaagcgcttggccagctcgcggcggaaggcctccaccaacccaatggtcctagcgtagggcatccgggtcgggcctaagacggcgatgataccttccccatactggtcaacttgatactttgctgtgatcaaactgtagtcatctaagacctggttgtcggcaatctcatttccaatccgaaccgagatatcgtgttcgtcatccggatctaaaatggcctgcaaattgttgccgtggtccaagagcgcgtacaattcttggaccgccgccgggttttgctggttggcaaagcctagcaaattcaaccgtccccccacaaagaagcgctcgtgagcggcccgggaagccaccgaatcaaagatgttcaagaagccctcgggttggtggaggtggcgggtcacctgcaacgggatgtccgtgacgaggcgcttaaccacctccggtaaggttagcccggttagctggtcgttgatcaatcgaatgactgcttccatggcctcggtgtcgatcccccggggcagggtgaaggattgactctccacgtccccggtgtccgttaccaagatggcaatcaccctgtggttgcccagcggaaccaggcgaaaaccacttaggcgggcgtccttttgctccggctttaaggtaaaggcggtgtaactcgtcaggttcgacaagaggtcggccgagtgcgaaacgatctcatcaatcttttggtactcggtacccaacgagttttgaattacaatcaggtcattttcagttaccgacaacggatccagtaagtggtcgacgtaataacggtaccccagcttggacggtacccgcccggaactggagtgctcctttgtcaccagcccttcgtgctctaacaccgccatttcgtttcgaatggtggccgaagagacctttttggccaggtgatcgacaagtgccttggagccgaccggttgaccggtcgtggtgtattggcgtacaatcgcttgcaggacttcttcttgacgtttggttagcatcttgatcacttccttttagcactctggccatctaagtgctaaatacaatgtataatataccaaccgtcccgttaaaagtcaacaaaagtcaaagatcttttcgcaatttatcaccgaggaacatcatgccagcagatcaccgttatatccagccccaaagcgccaaggaagccatggagctgatccaaaagctttttaattcataccgcaacgccccgctaactagcgagctattgaactaccataataacctggttgcccgtttaaacgacgatatcatggccgccgctaccaccgagggccctaagcgcgtcgaacagctgaccggcatgatcgagctaatgcaagcgtggacccggatccggctcagtgggcgccccttcttgggcaagatgcgccactttaaactagaagatggcaaccaacccaaatacaagcgccgggtccacaagataaacgggaccagcaaccaccgcgctagccgccactaattaaatcaattatcactgcccctccccgcgccaagtgcgtggtgaggggctttttagtgggggcaacatgggaccactttgttaaaaataattaccttttggtagattgcaagaaataacttgaacaaatttagtaacgcagattacgcaaaaagatctcaatcggtgttcgccaatttaaacatttgagtggttgggaattcaaataccagttaatttgaatcaattcatcatcggtaatctcatcaatcggttgacctttgggaatgaagcggcgtagtactcggttgcgattttcattactgcctcgttcatgtggtgaataggcatgggcaaaataaacctgtgtaccagttcgccgctcaattgtctgatagttagcgaactctttaccatggtctacggtaagcgtcttgagcttgtcttgaagttgactagctagttcaagtacggcttgagtcatggaccgactatcgcgaccatggagccgtttaacaattgtcaggcgactcttacgctccacaaaagtagccacagcttgacctttacgtttgccagaaagtacggtatcagcttcaaagtggccgaattcctggcgagtttcgactttattagggtataccctagtggccgtttttgatccattatcaatggccttttaaattagggcctagtacctttggaatggaaatactttccaacaccaaaaattctagacccgattatttttgttaaacgagatttctatatataatggaattataaatttacggttggaggtttttatgactgatttatttgcagatgggactatctctatccatggagctcaagaaaataacttaaaggatgtcagtttagatattcctaagcataaaacgactgtatttgctggtctttctgggtctggtaaatcctctttagtttttgatacattagccgctgtttcccgacgtgaattaaatgaaacttttcctagtttcacccaacaatatttgcctaaatacggtcaacctgaagtgaaccgaatcgacaacttaccagtggcaattgtggttgaacagaagcctattggtcgtaattctcgatctactctggcaacctacaccggaatctattccatcttacgtttgatgttttctcgaattggacagccttgggttgggtattctgaatggttttcctttaacctacctcagggaatgtgtccaaaatgtcagggattaggctttgttgacgacatagatgaacgtcaattaattgatcctaataaatcactcaatgaaggtgcaatgacttttgccggttttcaaccgggaacttggcgttggaaggaatatggcaacagtggattatttgatttagacaaaaaaattaaagactacaccgatgaagaatatgatttattcatgcacgctccgcaacaaaaattaaaaaatccaccggcaaattggggtcgtacggcattatatgaaggactagttccacgtatgcttcgctctgttattcatagtgcctcaggtcgtcatcatgaagctgccttatcaaagattgtcactcgaaaaccttgcccagtatgtcatgggacacgtctgaacaaaaaggctctaactggtaaaattgctggcaaaaatattgcagacgtcagcgatatggatttagtaagtgtcctaaaatttttggataatatctcggaccccaaggctaaaacaatggtgcgtgaactacatagtaaagttcaagctttggtcgacatcggtttaggttatctttcccttggccgtggaactgatactctatctggtggagaagctcaacgaattaaaattgccaaatatttgacgagttccctatccgatttagtttacgtactcgatgagccaagtgtaggactccatcctcacgatattaaattaattacccaatccttaaaaaagctcaaggaacatggcaataccattatcctagttgatcacaaccctgccattatttcgacagcagattatgtcgtggaaatgggaccacaagccggcaaaaatggtggtcaagtaactttcactggtacctacgacgaactattacggtcagatacgattacgggtaaaatgttacgagaaaaaatcactttcccaaagcctcgtgaacctcaatcttggctaaatgttaatcatgtaacttctcataatttaaaagacgtatctaccagaatccctcaaggtgtaatgaccgtgatatctggaccagcaggttctggaaaaagtactttagtccaagctttcaaacaacaagtttctgatcaagactatattgatttgagtcaagattctgtaagtttgaatattcgttctacacctgcaacttacttgaacattttaaatcctctacgaaagcttttcagtaaagccaacaatggcgtttcaacacaactatttagttataacggtaaaggtgcttgtccccgttgcaaaggtaaaggtgtgatgatcaccgagatggcattcatggatccaatcgttcaagaatgtgagttgtgtcatgggaaacgttatagccaagaagcactacaatacacttatcatggcaaagatatttctgaggttctaaatctttctatcaacgacactttaaagtttttcaaagatgtgccagatatctacaaaaaggttagtctactccaccaagttggacttggttatttgaatcttagccagtcgatgaccactttatctggtggtgaggtgcaacgtgttaagttagcaatggaattgaatcataccggccgaatctatttcttagatgaaccaacaaccggattgcacttacaggatactcaacaattgatcgatttatttgaaggattggttgataagggcaatacattaattctgattgaacataatctgaaattaatttcacgagccgattggttagtcgatatgggacccgatgctggtaaattcggcggtcaagtttgttttgaaggtcatccaaaagatagcctaaacgataaaaactctcggactggtgctgcattagcagctataatttcttaaaaggttcaaaaagatcacctcatttaaagtgcaacacaaaagttagacaaaattgaatatttttaaactgctaaggcatgttccctgtattcgcagggagccatgccttttgttttctgtgatattcgtcgattgttaaaccaatcgacgtaattctttgtgatttccttgaattctccaatatctttataaccaactagtcgccacaaaaggcactgccccataacgtgaaaacagcgtcttaaatttggctagttggttagcgctgataacgttagttgctgcggcgttagttgctgtcaattgggttgcactgtcactagcgctttgctgactttcgctcagtgataatgagcttaccaaagaagcggtgctagtcgaggtgctggcacttacggaagtggcggcactagcaacgctggttgatgataattgactggcggaagttgagttagtgctcgttgaagctgaatcagacccgctgttgctcgtggaagttgacgacttagtgctatctgagttactagttgagctactcgtcgaggttgaagcgatactctggctagttgacacagaggtgctgacactctgggaatttgcgatactttgactaagtgaatttgagagactttcactcgtggaaaggctcgccaaactatcttcactcgtggacgtcgtcgtgctcgtgcttgctgaagtcagcgttgcttcgttggtggtagccaaggcgtccgtcgtggttgtatcaacggacttggtatcggccatcgcgttttggttacccagaactgagaccccacctagcactgccccggtaattaaggtggcatcaatcagggcacgccccttcttttggtgctcctcgtctttttctaccaggttggcttcaacgtccttggcagagaagctgatcagtccaatcttggacattaaagactgaacccacttcttacctgacttataaagcttgacgtgggttgtccggtcgttttcttcgtagcccttaccaaacttgttccttctcataggccttaactcctcctaaaaatagtttcttagatccctgaaaagctcccccagtaacccataaacgtgtggttgcagttgcgtgctccacttgttagatgccttcatgcaatcctctaaatgaattacacgggagacggcctgtgagcacagcaagccttacagttatctattaaaaattattttatagttgaacagccattctttcaagtttcggttatctatcgatatactacatataaaaggcgataaaagccctatttatcaacgcttcaagtgtgcaacagttgttatattttcgttaacattccgaaaaaagttcgttgataagcctatgtatacaacacgcaaaccaatcactttaagttatcgatgatttagcaacttattaacttaacgctcactccttaagcgatttttctaatcccctaatttcatctataccaattagataaacttagcctggcgtttgtttatttaacattaacgctagttagaccaatctaaaatcaagcttctttttcttttgctcccctggccactcgtcacctccccctttcccgcaattcacaattggtcaacttaccatttttataaattgaccaccgagatttatattcttaatacgcgtcaagtgccgttgtaacggcattttcgcacctcctttctttatcttttcacgcctaattcacattgtcgctttaaaaggtatcggtcaccttaacaatcttttgtttttcttccgttttgatttcccaccggttctttcctatacttatggaaaaatgattgggagatgattgttgtgacaactgatttgttatcgctgagcgggactgagatggcccaggccgttcgggaaggcaaggttagcgctacggagctggtctctgctagcttggcaaagattaaggaagaaaacccggcgctcaacgccgtgatttcgttgcgggaaaaagcagctctaaatgaagcggatcaacttatcgatcggggccaacccttcttaggggtgcccttcttgttaaaggggcttggccaaacctttcggggcctgcccgccaccaacgggaaccgcttgtttcaaggtcaggtggcgcaatcgagtagcaactttgcccgggcactgaccaacgccggcttcatcgtcctcggtcaaaccaactacccggagtttggctttaaaaacatcaccgattctaaaatgtacggtgacgcccacaacccctggaacctggcttactaccccggcggctcctccgggggggccggggcggccgtcgccagcaagatggtcccgatcgccggggccagtgacggcggtggttccatccggatcccggcctcttggaccagcacgattggcctcaagccgacccggggccgggtaatcaccgggccgagtgactggcgctcctggcagggggcggccggcagcttcgcgatcaccaaagacgttgaggacaccgcccgcctgctcgacgttttacaggccctccaacccgccgccgtcttccaggtgcccctgcaaaagccgtcctttgccgacctactcaagcaaacggtcaagccggtgcgggtgggctttaccaccgaatcgccggtcggcaccccggtggacccagaagccgtggccgccgttcaccaagcggccaccttcttagaacagaacggctttgaagttgaggaaattgaggtgcccacggacgggcgggccctaatcgattcctactatttaatgaacgaaggcgaaacggcggccatgtttgaccaggtcgaagctagcctgggccgggccgtcaccgttgacgacatggaaccgctgacctgggcgctgtaccgcaccggtcgtcacatctcggcggcgacttacagcaacgccctggccgcctgggaccaggctggctatcagatggccaccctgcacgaagcctacccgctggtgttgacaccgacgacggccatgacggcgccgcgcattgatcaaacgatggtctctgaagcccagcttgaccagatgagagacatcgacgccctcacccccgccgcccagcaacggttcatcttcgaccagtggttgccgtcgttaacccgctccccgttcacccagcaggccaacttgaccggcgagccggcgattagcttgcccacccacctcaccaaagctggattgccgctcggcatccagttggtcgccggcaaggggcaagaggggctcttattacaggttgccaagctctttgaaacgcaggggcgcctgctgttgaaagactaaccatccattaattttcctcatcaatttcccatcgaatctcagcgccccctcattcttcggtaagggggcttttggagcgcctggttcccctccttggtttgtgtataattagacatgtaagcatattcatgaataaaggaggtggcgataatgcaagcacaaccggagaagaagcgacaccgttttaagatgccgtccgccttcacaatcttgtttattatcatcattatcattgccgttttaagctggttcattccggccgggaagtattcgaccgattccagcgggaacctgatcgctaacacctaccacaccgtcaagtccaacccccagggactctgggacgtcgtgatgtcgccggtgtacgggatggtcggtgacaagaacaccgacggggcgatctcggtttcactcttcatcctggttatcgggggctttttgggcgtcgtcaacaagaccaaggcgctggacgccgggatctcgtcaatcgtcaaccgctacaaggggcgcgaaaaggtcctgatcccgattttgatgaccctcttcgccctcggtggttccacctacgggatggccgaagaaacggtcgccttttacccgctcttgatcccggtgatgatggcctgtggctttgactcaatcgtcgccgtcgccctggccctggtcggcacctcggtcggtaacatggcctcgacggttaacccctttgccaccggggtggcttcccaaacgctggggatctcaccgggggacggcctggtctcgcggatcatcttcttcgtaatcgtcgacgtgatcgcgattgcctttgtcatgcgctacggcactaagattcaaaaggacccgaccaagtcctacgtctacgcccaacgcaaggaagactggaagtcctttaacatcgacgaacgaaccaacgacgtcgaacccatgactgggcgccaaaaggcagttatttgactcttcatggccgccttcgtgatcatgatcatcggcctggtgccgtgttaaaacccggtaactcgcaaaactggttgcgaattaccgggttttattggtttataaagatctctttttgacgattacacagataacgtgctcccaaccacaggcctagtgcctaagtctggtcgcagaacaccgctggcgcgctaacctgcgccctatccttagtcatacggcctgccgaggaggttggggcgcactcacttctctctacctaatcttcttaccccagtactggaacaggtcggtccgcaaggccccgttatagagcttgcgtttcttcgtggccggcgccccgtagaacttttcaaactccaggtcggcggtcaagatgtacttagaccaggtggtcagcggccggtagagttcccccatctggcggtaaagctcgcgtaccgactcctggtcggacaagcgctccccgtacggcgggttggcgacgatgaccccgttaatttggtcggtgtgccagtccttaacggctagttgcttgaaggtgatttcctggctcaaaccggccgcccgggcgtttttcttggcgatgtcgatcatgttttggtcgatgtcgtagccgtggatgtccaattcgacgtcgtaatcggcggcgtcttcggcggcatcgcgcaccgcatccgataagccctccggcaccaagttaacccagctctcgcaagcaaagtcgcggttgagccccggggcaatgttgtgggctaacagggccgcttcaatcgggatcgtccccgacccgcaaaccgggtccacgaaggggttgtccgggaaccagtgggccaacatgaccagggcggcggccatgttttccttaagtggggcgccccccttggccttgcggtagccccgcttgaacagggagctgccggtcgtgtccaggaggatcatcacgtggtccttattgatgaccacttctaaggggtagcggctcccggtttcggccaaccgggtccgccggtggtaaacctgggagagcttttcgacaatcgcctttttgacgatcgcctgggcggacgggacgttgtggagcttagagttgcggctccgcccctcgaccgggaagttggcgtctaggggcaacaggtcctcccaggccagggccttggtgccttcaaacaggtcgtcaaaggtgtaggcgtcaaactcgccgaccacgattttgatccggtcggcgcagcgcagccacaggttggtcttgatgacgtcttcgatcgttccctcaaagcgcacccggccgttttcgacttgtccctggtaacccaggtcccgcagttccctgccgaccagggcctcgatgccggccgcggcggtcgccagcagttgatatttttgcacgttaattacctcgtttttcagtctgccttttatcttaccacactattgggccagggtcgctaccaccagttgccacattttggcgtgctgttggttaaaaaagtggggcgcctcggtgggggcgaagaacttagtggttaaggtttcgcttggtttgggcgtttgttgacggtcgtgcaccctttcaactaggtaaaaagcgttgaccggttggaccgcatccccgttcgggtaggtgtaaaagtcgtcgtcttggattgccagcaacttgaccggagtcacggcgatgccagcgtcctctaaaaactcccgcacgacggtttgcttgaaggtatcgccgtactccatgtagccgccgggaaagccccagtcgcccgtatcggcccgctcctgcaagaggatccggccgtcttcgaccagggctcccgaagcgctagtcatgatcaggggggtgtggcccaccttttggcgtaggtcgtgaatgtatgccattgtctactcctttccccaccagtccggtaggttaacttgtccttcggcaacttcctggccgtcttggtaaaccaggacctgtccggtggccagctgctcttggctgcttcctaggcccagggcggtttgctcttccggggtcgtcaggcggtggaccaagacgttggggaactgggagcgcaactcggccggtaagtcgagcggtgactgggtggtcatgatcatggataaccccagtttgcgcccctcgcgcaggacctggaagatcccgttacgggctagggccgccccgttgcttggcaagtagcggtgagcctcgtcaatcaccagcttgaccgcaaactgccccggcttagccaaccggaaggccaacagccgctccaagaggaccgagattaccgtcgtttgcccctgaccgtaccgcttgagggccgccaggtcgagcaccagggtcttgtggttgctacgctgggtcatgaacattttcaagacgaagttgagctcggtttgaacggcgccgggggtgggaaccgtgccaaagagggttcgcatcgccggggcgttaaggcgctcacgcagggccaacagctggtcccagtgggcgttcagcgccgcccggtcgtactcctggccgaggagccggtagtcggcccgctcgtctgggtaggggtgcaccgtttcttcaaccacctgatcgaccaggcaaccgaggtcgtaatcgctggtccactcccccaacctagccacctggtcttcaaactcactcgccaggcgcccccgcttttggtagacgccgggggtggcgagcaggttcttttggatacgtagcgcggtgattgcggcttcgagcttggtcaccaaccacgggtccgccggcagttccagcacccgcaataactgcggcgccgttaaggccccggcctccaagtaggcgttaacccccagccggtaggtgatcgtgttggggagcttggcgtactcgccggtcgggtccaggatgatcgccgtctggctggtttgttgcaactgcgacaagagggccagggtggtggttgtcttgccactgccggtctggcccaccaccagcaggtgccgcttcgtcagctcggtagcggtgacccgccccccggtttgttccgtcattaattccgtcatagtcttcccccgttctatcattttccccattgtagcaccccagccgggccacgcaagtaaccttattattaaaattttaattaaaatctaattggattattattccccggcctgaaaattaagagggcccgcccctactaccgcggctgggccgtcgtctggtagggcacgtgcatcgtttgggggacctgatcccaggcgaccgggtaaccagccccgtgggcgcaaaagaccgagtccggcgtgttagccaagtcgcccaccggatcgtaattggcagcctcgatcagtggggttgggtccgctaccggtcggctacctgccggggtcagggttaattgcccctggccgtgggtgtaggcccgcaccgtcgccgcgtaatcgcgcaacttagtgaccgggccactcccctccaagcgcaccaagtcgccaggcccggcttggggttggctaacttcaccgccaaagcgttgcaggtccgtcaaagcgtggccgactgcctcggtggggaccagtaactgaaagttataccagggttctagcagttggttgcccgcccggccagcttccattagcccctggcgcagggcccgccaagccgcctggcggaagtcgccgccgacggtgtgaacgatgctgcccttaccaccgaccaaggtaaccttgacgtcggttagcggggcgccgactaggatcccccggtgggccctttgcttgagggcggtcaaaatctggccctgccaggcgtttgataagacgtcgacgtggcactggctggcgaaggtcaagccactcccacgggctcccggttcaagcaagaggtgaacctcggcgtaatggcgcaggggttcgaagtggccgaccccttctatcggggtggtcagggtttcttggtagcggatccgcccctcgtcaaagcccaacgttaggccaaattcctcttctaagcgctgggtcaggatttctagttggacctcccccatcacctggacgtaaaggcgctgggtcgccgggtcgtccacgacgcccaacagtggttcctcgtcttccaattgacggagggcggctaaatattggtcaaagggcgctccccgttgatccaacccgtaggtcaagaccggccgaaagcggggctgggcctgctcttcaaccgccccgattccctggcccagcacggtgctagtgggccccgccaccgtacaaacctgccctgggccgacctcctgcaccacggtggccttagcgccattgtagacccggagctgatcggccttttgccccggcagcaactccgctttggcccgcaagttgccgccggtcacccgcagccaggtgagccggttgccccgctcgtcgtgggaaaccttaaaaacccgggcgccaaaatcgggcgtcggggtgggcgtttgagtccactccgttaaccccttaatcaggtccgccactccctcgtccttgagggcggcgccaaagtaaaccgggaaggcgcgccggtttttgatcaagctccggagctgggcgggagtgatttcaccgttcgtcagataatcgtccatcaccccttcatccaggagggcgagctcctcgaactgggcagcggggtctttaaagggcaggcaaccggggtctaactcgtcttgcaactgcgctaagaccgccgcctggtccaccccgggggcgtccatcttattgacgaaaacgaaggtcggcacctggtacttgtccaggaggtcccacaggatccgggtcgtcgcttgcaccccggcgggagcggacaccaccaggatggcgtaatcgagcaccgctaaaacccgctcggtggccgccaagaaatcgatgtgcccgggcgtatctaggagggtgagttttaagtcaccaaagctgagctcggcctggtgggggaagatcgtgatcccccgctgttgttctaattgatcggggtccaaaaaggccgaccccttatcgacccggcccagttgacgggtgaccccggcgtggtacaagagggcttcggatagggtcgtcttcccggcgtcaacgtgggcgaccagcccggcgacgatttgtgacatgatgctaccgcctttctatagtaagtgagtacgacccaaccgttaagcaggccgtgggctaagctagggtgaaggttagcgcctcttttctatgtacaaaaaaacccgggatttatcccgggtgcctggatgcagacttctgtaggccatgttttgtcaaagtccggtcctcaggcaagaccgaaccgtggtaatcatctatctcagcgcaagatgcgctcccctggaatcgcttcaattcgctatccaaagctcccctaccgtagtttgggtttaccgcttgaggggtttaccgcgttccaccgttaaggtttcccttaacgcttcgtcactgtggcacttttcaggaatactgaggcatagtaaaaccgtagcccgtttttccgccgtcaccgggcaagccggtgccccgccttattttttcagcgagcacaaacactacgggcatcgcagcccgtgcgagcatggaccttcctaacacgaccgttgccgtgctcaattacccaaagcctgcatcgaaaacctgtggtcaattatagcaagtgagaatcgttttcgtcgttacccagttgggaaccaaagacgcgccgttccaggttggacagccgctttaagatatccatgttggtagctgacgaaaccggttggctcgccgccgaccgggaactaatggaagaaccgacttcgacttggcggtttaattcgtccaccttggccttcaaacgatcattttcgtcttgcagccgggttacttccttgttgaaggcatcgtaatccttaataacatcgtctaagaaggaatctacgtcatcgacatcgtaccccttcccgatactcttctccttaaactgcttgtgcagaatatcttggggagtgaatttaatgttatccaatctcaacacctcatctcactaagttatgactggttaatactttattattctaccaaaatctgtctaaaactcaagggtaacttttcatcttgaccatttcttaatgatcagtccgtcattcccccctcgttttgctcggccgcccactcgttggccgcctcctccaaggctggcatatcaattaagtcgacttggtagtcgggaaagtcctcttggtagcgcttggccgcgcggtataaccagtagggcttgctcttttggtccgggttgttttcctggtcgggatcgtaaaccaagaggagccggtcggtgtgctcaaacatgaagcgctggtacatccgtagctgctcgggtgactggtagggttggggggagacctcggcactaaagtcgacgttcgcctttaagctggctaactgggcctggttggcctcgttccaccggttggcaaagtcggcgaagggcaacatcatggcgacctttaaacaggggtaatcttcctttaaggacagccccgcttcggccgaccactgttccacccccagctgggggccggtaattagccagctttcttcctcgttttggttcagccactgggtcaaaaactcttttaacacccgttcaatgaccgttttcttggggtctttggggtcaaagacggctaattcaaaggcccggtaaccactcacccaaattcgttgcataaaaaaactcccccatctttaagttgacaaagattgctagaccgctttctctggtataatgtaacacgtgtagttaaggaggtaaatcgagatgacgatcagataccccagtgggcaacaaccgccaaacgctggtcgggcggggcagccaatcgtggcgccccactcctcgagttttgccaagcgggggatgtccctggaaaaagaaatcaacgacgctaaccgttattacctggccactgagcaggcggtgatctacaaaaagccgaccccgatccaactggtgaaggtcgactaccccaagcgcagtgccgccgtggtcaaggaggcctacttcaagcgcccctcgaccactgattataacggtgtctaccagggttactacgtcgattttgacgccaaggagacccgggggaaactttcttttccactcaagaacttccaccaacaccaggttgaccactttcggcggtgcctggcccaggggggcgtctgttttgccttcatccgttttaccacccttggcctaacttacctactccccgcctccgacctgatcgcattttgggatcagcaaggacggggcgggcgtaagtcagtccccttaaccaccattaaagatcgcggctttcgggtcaagaccgggctcaacccggtgctggattacctgccagctcttgaccaactgatcgccgcaaaccaagctaaaggagcagatcatgaataatgaagaagtttctcggcgaagccaacgcccccacaaggatcgcggcggccggggacggggctcgattctaaaacgaatcttcttgtgggcccttagtctcttcgtcctcgccttcgtggcactggcggccctgtttttctactacgcctccagcgcccccacgatcaccgaaaacgacctcaagagtcaaaccaccaccacgatttacgatgccaacaacaaggtcatctcgcggttgggggcccagaagcgtgaatacgcctcgaactcggagattccaaccctcttaaagcacggggtcgttgccatcgaagaccgccgcttttaccaaggccacggggtggacccggtccggatcgtggaagcggcgatcgacaacgtcttacaccgttcgaacgggatgcaaggggggtccacgattacccagcagttagtcaagttgtcggtcttttcgacggccgcttcggaccaaaccttcaagcgcaaggcccaagaagcctggctggccatcaacgtagaacgccacttcaccaaaaaccagatcctcgacttttacatcaataaggtctacatggggaacggggtttacgggatgaagacggccgcccagtactactacggtaagagcctaaaggaattggacctctcccaactggccctgttagccgggattccgcagtcaccaacctactacaacccggccaacaccgacactaagccggccacccagcggcgcaacgaggtcttggccgccatggtccgggctaagtacattacccaggcccaggccaacgccgccatgaaggaaagcgtcaccgacgggctcgattccacccacggtaacaccagttccaacgattctagcgttgacgaaaaggtggtggactcctatgtcaaggaagtcctgacccagctggaagccaagggatacaacccgaacactgacggcttgcaagtgcacacctccttagacctgggggcccaagaagaactgtacaacgccgctaacaacacggtttccttccaaagcgataagatgcagaccggggtcgccgtcgtcaacccgcacaacggtcaagtggtcgccatgcttgggggccgcaagaccggggacgtggtgtacgggcttaaccgggccgtgcaaaccgaccgttcctccgggtcaacggccaagccgatcatggactacgggccggccatccagtacctgaagtggccaacctactacgccctgtccgacaccaagttcaccttcccgggcaccaacaccgtcttgcacgactttgataaccagtacaagggcacgatgacgatgcggaccgccctggttgaatcacggaacgtgccggccgtccggaccctgcaagccgtggggatttcccgggccactaagttcttaaagggcttagggatctcacaaaagtcggcctacaccctggctaacgggatcggcctctacgtctccccactgcaaatcgccgcttcttacgccgcctttgccaacgggggaacttactacaagccgtactacatcacttccattaccactcaggatggcaacaccatcaactacaacaagagcggtaaaacggcgatgaataaggcgacggcttacatgatcaccgacatgctcaaaggggtcatcaactcttccgatggttccggaacggccgccaagctctccggggttaaccaagccggtaagaccgggacgacctcggcatactcggcagccaccggaacaacttccaacaccaactccggggtcatggactcttggatggctggttacactaagaactactcaattgcggtttggactggttttgacaacgccaagacctcgatttcctcctcgtacaccaaggcggctcagtacctctaccgggacgtcatgcagtacctggacgccgaaaaccacgccagcgattggacgatgccaagcacggtcgaagccgttcaagttaacggggtccggcagttggtaatcaaggactccaagtgggccctgacggttacctcttccacctcgagctctagttccaactcctctagttcaacgagttccagttctagttcttcaagatcgagttcttctagttcctcgagtgaaagttccagttcgagctccagctctagttcgagttctagttccaccccgtctagttcgagttcctcaagcaactctgcttcgacgccaactcctgctagttccacccctacgacaacgccaacgacaccaacgcaataaagcaataaagcactagctgaatacaaaataagaggcctggagaaagcagctttctccaggcctcttgttgtctattcgaatgtcaaacggaaaacgtggccaataacatccaccctattcccgatacgccaagcgttggcgtccccgttgtaggatgtaaatggcgatgatgacgatgacaatcccgagcgcttccacccagtttaggttgaggctgaaaaagatcaccgataagatcgtcgtcacgattggttgcaccgcgtccatgatcgaaacaacgtcggacggggcgaagtgaatggcttctaacaagaggccaaacgggatcgccgtcccgaacaagacgaccgtcgccaccgaaccaaccagggtgacggtgacgtgaggcgggttaacccaaaacgggtggtagaggttaaataagatcccggcgatcatcgtcccccaccctaacaccaccagcggcgggttcgtttcgttagccttgcgcggcaagacgacgtaaaaggcggcggtgatcccggaaccgatcccccacaacagcgaaaccagcggaatcgccaagtgggcgaagtcaccccgggtgatgcaaaggaccaccccgaccagggcaatcacaaaggccaaaacgtcgctgcggattggccgttgccccctaaccacgctgcccaacacaataaagaggggcgccaggtattgtaaaatcgtcgccatcgaggcgttcccggtctggatggcgtagtaaaaggttaagaggttggccatcagcccgaagatggcgtatgtgatcaccgaaagggcgctgcgcttgtcagcaaaaatagcaaaggtcttcttaccgtacaaaaccagtgaaatggcaagcagtaagacgccggcggaaaaggtccgcattgacagcatccacggggctgggatggccaggttttgcgagattagttgcaaaaccgtgccggaaatcccccagctccccgatgccaaggccgccagcaggatcccgcggctgacccgacgatagttattcatgttcgttccccctaaaattagttacgagtaccatcctatcataaacgaatagccggcgccatttctttggttggtaagggcggcctgcggggctattattaaaagaaaacgcttgcggaggaatgattatgcaactaaaagtagaccgttatcaaaacatgacttaccggcgggtcggcaagagcggcctcaagctttcggccattggactgggcttttggcacaacttcggctccgttgacccgttcgatcaacaacgggcgatcatcaaggccgacctcgacctagggattacctacttcgacctcgccaacaactacggcccgaccccgggtagcgccgaagaaaacctcggccggctgttgaggaccgacctaaagccctaccgcgatgaactggtgatcgccaccaaggccggctaccacatgtgggagggaccttacggtgagtggggatccaaaaagagcatcattgcgagcgccgaccagagcctgacgcggctggggttagactacgttgacatcttttattcccaccgccccgacccagagaccccgtttgaagaaaccgccctggccctcgaccagctggtccaccaagggaaggccctgtacatcgggatttctaactactccggcgcccaagctaaggaaatggcgacgatttttgacgacttgaagaccccctacatcgtctgccaaaatcgctataacctctttaaccgccaggtcgaaagcgacctcttccctgagctcaagcgggctggcaaggccatggtcgccttctcaccgctttgccagggcctgttaaccaacaagtacctcaacggcatcccggcggactcacgggcggccaagacgaccagccccttcttgcacccaagccaagtggaacagaccctcgccacggtcaaaaggcttaaccaaattgccagcgaccggggacaaaccctggccgaaatggccctttcctgggacctgaggagtgacctggtggcctccgtgatcgccggggcgtcgcggccagaacaacttgtcgccaacgtcatggcgctcaacgcccccgccttcaccgctgatgaactgacggcgattgacgctgctctggcggcccaggcggaggttgattggtcaagggaatagggaagtgtgacccaccggtaaggcaggccgtgggctaaggctcggacacaggttagcgcgtcagtggtgttctgtggtctgacttagccactaggcctgcgggtggggagcacgttattggaagtgtgacccaccagtaaggcaggccgtgggctaaggctcggacacaggttagcgcgtcagtggtgttctgtggtctgacttagccactaggcctgcgggtggggagcacattattggaagtgtgacccaccagtaaggcaggccgtgggctaaggctcggacacaggttagcgcgtcagtggtgttctgtagtctgacttagccactaggcctgcgggtggggagcacgttatcttagggaagtgggaaataacctcctcggcaggtcgtatgactaagctcggacgaacggttagtgcggaacgcactgttcttcggcctgcttaggcactaggcctgcggttatttaccacgttttctgtctaacattcgggaatacaacaagaggctgggagaaaactgtgttttctcccagcctctatttttctttcttagttaaacaagttttggatccaggcgatcagcttttggaaccagttttgggcgtccttgaccgccgtcttagcggcttcggagttggcccagttcttggacttgttcatcagatccccggtcgagtttttaacgttattgatcgtgttagtcacgttattaacgtaggtcttggaactagagatcggcgaatcccggaaggtaatcagggcgttgacgatcgtcgtttgggcgctagaactggtcttggaggcaatcccctggttctccagggccttggttaagatggcctggatctgggcggaatcgtcagtttggccgtcctgcttgtcttgggcgacttgcttagaaacgttcccgacggcggccattagcttacccgggtacgaggagtcgcccgagttttcgttaattgccccctgggtggcgtccaggacctggttggcggcgctggtgttttggctgtccaggttctgcccgtcagcggccagggccttgtaaaccccggtcaaagcagattcaccggacacggcccggttggcggtcacaacgatcgtgacgtcggttaccccggccatctgggccaccatggcgtactgttgggccgtcacctgggtgatgttggactcgccgtcgtacttcttgatgttaacccgcaccccggaacccgggtcggacggggcgatcgcaaccgatgaaatcatggcggcgttggtggtcgtcccgttgccgatgtacttctcatagtcactcgccgtggcggtcagcttttcaaacgaggagtcgacccccatcgtcgaattcagggtggagtaggcactctccggcgcccccgcaccgtacaccacgtaggatttggagatcgtgtgggtcgtcgacgtggtactggatgatgatgaacttgcctgggtcgtcgtgtcggcgtgggcccgcacggcggggaccacggccccgccacagaggagtgccgctaccatcagcgtcgtcattagggttctttttttcatcgtaattcctccgttaatgaaagtacccttattatacccgtttagctaagcaccgggggctttttcagcacgatttagtgattaattaatggttgccggctactcggtttggtcggggtgcagttttttaagcgacgcctttaaaactaatggtttatcactggttgaacccgggcgcccttccccccgttgttcccgcgccagctcgtactggtgcttatcggccatcacttgttgtggcgtcgtcaagcggctctggcgccagcgccgcaagatcccttcaatgtacttcaagttgtacttaccggccagcaccgcttcttttagggccagctgaaccaaatctaactggtagtggtcctcatccagccactggttgaccgtttgcatctccatcggcgaaatcgtgcggccaaactcgacttggatctggttgaagagttcggaccggctgaggtcagcctgcttttgttcgttgaccacccgctcgtggtttacggcccgggccaaacggtcgtagaggggggtgaagtcgtagtaggcgtcctccttgccatccggttggcggcgcaagcgctgttcaaccaggtttttcttggtcatttggtggactagctcaaacacctgcttggaactggtccccaggtgatcggcaaccagctcgaggtcgggggtcgggttcccccggtcaatgtaagacttcagctctaagtagaccattaattccccggtggtcatgtcgatgtcgtggtagtgatgcaacaagaggttggaaacgttggtgctccctgcctccagcatcgtcatcaagaattgattttccgccatttttcctcccccactaggtgctaacaagaggaggccgggaataaccgcagttttcccagcctcctcttgaatttttaactatcgctatttattacgggtacagacggtttaagagccgtgggaacggaatcgtctcccggacgtggtcttgcagggcaatccacgttaaaaagcgttccagcccgagcccgtaaccggagtgcggcacggaaccgtacttccgcaggtctaagtaccattggtaatccttttcgtctaaaccggcgtcagcaatggcttggcgcagggtttcgtagtcagtttcccgttcggaaccaccgatgatttccccgtagccttctggggccaagaggtcggcacagacgtaaacgtcgtcgcgagtcgggtggcccttcatgtagaacggcttgatcgccttcgggtaattgagcacgaagaccggcttagagaattggtcggctaagtaggtttcctccggagaaccgaagtcttcaccccacttgatgtccatcccggccttttgcagcatttcgatggcttcatcatagctaatccgcgggtacggcagctgggtgaacggctttaaggtttccggatcgcggccgagcacttctaattcgcggctgcagtcgtcaattaccttttggatcaggtaggccacgtattgttcttgcagttccaagctttcttcttggtgcatgaaggccatttccggttcgatcatccagaactcgatcaggtgacggcgggtcttggacttttcggcccggaagaccggcccaaaggagtagacccggtttaaggccatcgccccggcttcttcgtagagctgaccggattgggacaggtaggcgtcttggtcgaagtattcggtgtggaataagtcggtcgtcccttccggtgcgttcccggtcagaatcggcgggtcgatcttggtgaagccgtgttcaccgaagaattcgtagttagcccggatgacccggtcacgaatccgcatcattgcttggggcttgctggaacgcagccacaggtggcggtgatcgagcaagaagtcgatcccgtgttccttgttaccaatcgggtattcatcggagtcgccgatcagttcgagttcttcgatttggatttcgtaaccgaacttagaacgggtgtcttcgtggatttccccggtcacccacaggctaacttcttggcgtaggtggcgcgccatttcaaaggtctcttcgtcgaccttattttttaacaagaccccttggaaaaaggccgtcccgtcacgcagttgcaggaaggcaatcttcccgctggaccgcttatcggttaaccataccccaatgcgcacgcgttcgttgacgtgcttgggcgcatcaatgatgttgatggtttgcacaataattccctccaaatagtggttgattataagttgttgatttgttggatgctcttgccactggtgaaactaatcaggtcataacacaggttgcccttttggttcaagtaggtcacttcccaaaccggcttgttgttaaagatgcccatggccaccttcaacacccgcttggggttatcggccgttttaacctcacttttggcctgactagccgttaatccggcggactgcttgaggacccggatgtcgccccccttttgaggcaccaccaccaaaatagtttggcccttcgcatttttccccgccaccgtgtagtaggtttggtcccgattgtagatgtaaaaaccgctcgtggactttaaccccgcgtactttttcgccattgccgtagcctgcttttgggcggccgcccgcgggtggttagcaatggcgtacacgctccaagtgaccaagatgaccagcaaaagcgtcacgacaatgttgcggaccgtctttttaaacgaccgccgactttgctgacgctgaacgtctcgccgactttgcatagaagccttccttcctaaaaatcaatatctttattattatagcaaatttctcactcgttcgtggccgattccggaccttttaggaattttttggtttttaccacgatcaaatcgctactttcggcgatcaccggcagatcactcggcaaggctgcctggatggttttaccgtaacgcttggtgacgaggcgggggtccaagacaaccgctaccccccggtcctgcggggtccgcaagagccgccccagcccctggcgtaagcgcgtggtggccttcggcagttccacttggtaaaacggattcttgccggccgccttcaagagggcgctttgggcccggttaatcacatcgttaggggagtcaaaggggagccgggtgacgaccaagagctccagttgttccttaggcaggtcaatcccctcccaaaaactagccgcccccatcaacagtgaattggtgccggtggcaaactgcttcaaaagcttttcccggttacccgagatcccctgggccaagatgtcgcgttggttaaagaggtcggtgttacgcaacttggcgtagacctgttcgatcgttagaagggagttgaacaagaccatcgtttggcactgggtcttggtggccagttggtaaatcatcttggccaggtaatcaatgtaatcctcgcccgccgtggcgcccggcgctggcgcatccttggccacgaagaggcgggcgttttgcccgtagtcaaagggtgatgcgaagcgtttcacccggacctgcttgcgatcgaggtcgagctggttaaaaatgtaggccgaccgccccgaggtaaagagggtcgccccgacgaagaggtggttcaaaaagtgggggtaaacctcgcggctcaggtagtggttagctaccaagaggcccccggacagcttgagggtgctttgctcgtccccctgacgaatcgtcaaccagaagacgcaggcctccggttggctagccaggagctgaccagcctccttaatcatcctggtggcttccttcaacccggccagctggctcgcaaactgggtcattaggtaacgatcggtcgccaaccaagtttcgatgcgggaggaaaagaggtggtttagggcggtgaagtggaggttaatcgccgacagggcctgctctagcccgaccattagcgggttggtcggggctagcatcccggctaactggcggttgtcgatggcctgttcaaccaattccccatcttggcccccctttaccaggccatagagggcctgttgaaagtccaccaggcgcccctcgagttcgcgcagatcgctcgctagtaactcgacgttgtaagcacccaggggaaggttttcaaacagggttaccaggttctgctccccggtctggttgaccaggttttggagctggtggaggatcatcatcacccgcgcgaaggtcagggtctgccgcgattgacggaggaccgcccgactcaggtgctgggcctcgtcaacgaccaaaaaggcgccccgatcgtcgccacccagttcagcggggtgggcaaccaagtaggcgtggttggtgatgattaggttagccgtggccacctggcgcgcccggcgaaccagaaagtcatcctggtaaaagggcgactgcttgttgagggtccgtaccccgcggtggcgaacctcaatgaagtaggccgcctgctgggcgtttaggttcaactcgtcgaggtcgccggtcgtcgtctctaacagccacaccagcatccgggccttgagcgcctgggccagctgggaatcctcgtgcacggccagcgagtgggcgaagcggtcaatacttaagtagtgatcgttgcccttcaccaccaccgccgtcaactggaagggcaggtggtcgtttaagatggcgaccgtttgcttagccacctgctgttgcaagaggttggtggccgttgaaaccacgatccggtggtccgggtaggtcaaataggccagcggcaacaagtaccccagcgtcttccccgtcccggtgccggcctctaagaccaactggcggaccggctcgtcctgggagaactggttatagatggcgttcatcattttggactggagcgggcggtaggcgaggtcatcaccaaacaaatacttcttttggcgcttggtggccgggtacttccccgccacctgggcggtcggcacgctaaccgggcggaccttgtggaggaccaggccgtttgaaacgtacagctcctctttgagcggctggggttccaccgcccgcttggccagttcccgttcaaagagccaggccgtcttctgcggcagggtcaactgcaagtcaacgatgctttgcagggtgatggtcggcaggtcagccagccgctttaagagctcaattaggaggtgggcggtcgcgactgcgtcggaaacagcgctgtgcggttgatcgtggtcaatcgccaggtaactggtcagatcccggagccggaagctgggcgccgtgggcattaaaatctgactcaaggtaaccgtatcgatcgccgggatcgtcaatggcgcttcccccgcccgttcaaattcggcgtttaaaaagggaaagtcgaagttgacgttgtgggcgacgaaaatggtgtcatctaagaggctctttaaggtcggcgccacgtcttcaaacaggggggcgtccttgacgtcgttatttttaattccggtcagttgttcaatggttaagggaaccaccgtacggggattgatcttggtttcaaattcgttgatgacctggccgtcttggaccaggacgcaaccaatctggatgatccgtgaaccggtcttaacgctggtgccggtcgtttctaagtcgaccaccgcgtacactggtccccgtcgttttttctttgccaaactaaccatcccttcgtttctaaaattcttctatcgattgtactacactttgcccaggcgacaggacaaatgtttagattttacctgtggataaaaagtgagggctttgcctaattctactggtcaactaagtcaaccttgccccaccgcccctagttagtggtaaaatgtagttttgcaggtgtaatgacaccacccaaaaaaaacggcatctcaatagaaagcaggtttgacttcatgcaagcaagcgtcagtggtgagagccacgcaaaaattattttgatgggcgaacacagcgttgtctacggagaacccgccattgccctaccgctacccagcgttgccacggtggcaacattaacccggggtggcgtgggaaagcgcctgacgtcacgctattttcaggggccaatcgaggaacttcccgcctcaatgaccggggtgttgaaactgctcaacgccctgaccgaccgcttcagcccggacgataattgggaactgacgatcgaaagcgacctccccgccgaacgcgggatgggctcgtcagccgccacggcgatcgccattatccgggccttcttcgccgcttatcacgaggaactgagccacgcgcagctgcttgagtgggccgacattgaagaagaagttacccaccggagccccagcggcctagacgctgccaccgtttcctccagcaccccgctttggtacgtgaaggggcaaaccggccaagccattgacatggagctgtccgccaccctggtaatcgccgataccggcatcaagggggcgaccaaagaagcgatcgccgccgttaaagaacaactaacaaccaacccggctcaaaccaaggcccgtttcgcccacatggggcacctggtcgaagaaaccaaggtggccctagccaccgatgacattacccgcctcggcacggcgatggacgagtgccaacaagacctggtggcccttggcgtttcttcgccggccctcgatcacctggttgccgtggccaagcaaaacggggcccgcggcgccaagctgaccgggggtggcaggggcggttgcatgatcgccctcaccgctaccgccatgggggcccgcaagctagccgccgtcctaaaggaaaacggcgccaccgcgacctggattcaacccctgaaaggagaccattaacatgaccaccaccgcccgcgcccacaccaacattgccctggtcaagtactggggcaagcgcgacgccgccctgatgcttccgcaaaccgactcgctatccttgaccctcgacgagttttacaccaccaccaccgtcaacttcaaccaggcccttaacgaggaccagttttacctcgacggtgagttggtgagcgccaacaaggcccaaaaggtcgtcaagttcatggacctggtgcgccagctgagcggacgaaccgaatacgcccagattgcctcggtcaacaacgtcccgatggcggccgggctggcttcttcggcctcggcctttgcagccttggccggggccgccgctaaggatgccggcctagacctctccttaaaagacctaagccgcttggcccggcgcgggtcaggctcggccacccgttccgtttacgggggactggtagaatggcaccgcggggtcgatgacgccacttcctttgccgaaccggtgcaagaagtccccgactttgacattgccatgttggcgatcctcgttgataccagccaaaaaaaggtctcctcgcgcggcggcatgcaactggtagtggaaacctcaccgtattacccggcctggcgcgaagtcgttaagcgtgacatggtggcgattaaagaggcgattgccaaccgtgacctaccaacgattggccacatcgcccaggaaaacgccctgcggatgcacgccctcaatttggccgccgacccgggctttacctacttcgacggccaaacgatcctggccatgcaaaccattgatcgcttgcgtgaggaaggcttaaactgttactatacgatggatgccggtcccaacgtcaaggtgatctttgacccgaaggaccaagacgacctcttaaacgccctcaccccgctctttggggccgagcgactggtggttgccaaaccgggcccgggaattgaattcctcacagaaccggtaatgaaattttaaatgagaggatctaactaagttgattactgcaaaagctcccggcaagctctacattgccggcgaatatgcggtggttgaaaatggctaccccgcaattttggttgctttaaaccagtttgttacctgcacgattaccgaagccaaggatgaggttggccaaatcattagccgccagtaccacgataactccttgcagtggcggcgccgtggcgatcagatggtggttgacaagcgcgacaaccccttctcctacatcctgtcggcgattaacgtgaccgaagaatttgcccgcagcctcaaccagcgcctggggatttacaacatccgcatcgacagccagctcgattcccaaagcggcaagaagtacggcctgggctcttcggcggcggtcacggtggcgaccgttaaggccctgtgcgaatactaccaactgccggtcaacaaggaaatgatctttaagctgtcttcgatcgcccacttcgacgtgcagggaaacggctcgctgggtgacgtggccgcctccgtttacggcggttggatcgcctaccggtcctttgaccgccagtggctgtccgaacagcgccactacctcgacttaccggccctgctttcactgccgtggccggacctcaagatcgaaccactcgatgccccggccaacctagccctgctgattgggtggaccggcaaaccagcctccacctcacgcctggttgataagatttcactctttaaggccaagcaacaagacgagtaccaccgtttcttggaccgtagcaaggcctgcattcaccggatgatcgacggttttcacaccggtgacctcgataagatcaaagaagaaatccgctacaaccgtaacctcttgcaggaattggcccaccgttccggggtccaaattgaaaccccgttattaaagaagctgtgccaaatcgccgaagaatttggcggcgccgctaagacctccggggctgggggtggtgactgtgggatcgtggccatcgatggtcacgccgacctgcccgccgtccttgattcctgggctaagagtcgcatcgaacacctaccgctgtcggtctacttcgtcaacaacatccgccgctacaccctacaagttaagcaacgctaatccaaccacgaggcgggcgtctataatgacccgccttttttaggaggtttttgcaatggaatctgctcacgcccaacgtaaaaatgaacacctttccctcgccgaaaaagactttgcgctcaatcaccaggttcacccctttgatcaggtgcgcttaataccgaatgccctccccgaaatggcggttaaagaagtcaagctcaagccagcgggcttggccctgccctttgagtggcccttttacattgaggccatgaccggggggagccaacggaccaccaccgtcaacgcctccctcgcccgcttagccaagcaatttaacttggcgatggctaccggttcgatgtcggtgatgtttaacgacgaggcggccaaggaatcatttgccgtccttcgcgaggaaaacccggacggctttttaatggccaacctgggggcgggcgccgattttaaaaaggcccgtcaagtgattaacttcattgacgccgacgccttggagatccacttaaaccccgctcaagaactgatcatgaaggagggcgaccgcgaattttactggttggaagcattggccggcttagttagccgcctccacatcccggtgatcgtcaaggaagtcggcttcggcatgagccaacaaaccatctctcaattagaacaaattggcgtgcggtggatcaacgtggccggcaccgggggaaccaacttcgcccggattgaggaccggcgtaaccacgaactcgacctgagtgacctggttaactgggggctgtccacccccgaaagcctcctggaagcccagcaaaagtcgccttccacccacttgattgctagtggtggcatcacctgcccactggacgtaatcaaggccggggtactgggcgccaaggcggttggggtggctggttacttcctccacctcctgatcaaagagggcgaagaagggttagccaaggaactgcaccgctggcaagttgaactaccccggttaatgaccttggtgggggtccgcaactgggatgacctctacctagttgactacctgttgagcccagaactggaatcgttcacccggcaacgcggcttagtcaaccgacgggggatggggaataccgcccacctcattaacccgcttggctaaagagagcttggcaaacaaccttcccgacaggccgtaagtaaacttggacgaacggtgattgtccccctttttacctaacattcggatatacagcaagaagctggaagaaaaccgtattttctcccagcttcttttttgtggattggccaccctcttttacccaaagctcccggttaggtagtcctcggtcgcttggaggtggggtttagcaaacatagtggcggtttcgttatattccagcatgtggcccatgtggaaaaaggcgcagtagtcgctgatccgcgaggtctgttccaggttgtgggtgacgatgatgatcgtgcgcccctcctttaggcgggccaaggtttcttccagcttagcggtcgacagcgggtccaaggcgctggccggctcatccaagagtaagatgtccgggtcgaccgcgagggtcctggcaatgcagagccgttgttgctggccccccgagagggcgagggcgcttttatccaggtcgtctttgacctcatcccaaagggcgacgtcttttaagacccgttcaacggtcgcatccatttcctgcttatccttcatcccgtactgcttgggcgccaacaagaggttttccctgatcgagcgggcaaaggtgttggggtgttgaaagaccatcccaatcttttggcgcacccggtaaacgtcggtggtgacggtattgatatcgacatcgtcatagatgatcttgccggtcaccttggccacctcatcgttcatccgttttaagcaccgcaagtaggtcgacttccccgagccggaggggccaattaaggccgcaatttggttcttgggaaagatcaggctggtctccaccagcgacggtttgtccgggcggtagtagacgcaaaccttttcggtgtgaaagatgctgggtcccgccacggcaacggtgtaggtttcggccgttccaattatatcaattacatttactcagacaatttaagtttttctagtagtttcgtagagtctggaaacttaaccttgcgtccgaagaaataattacctttttttatggctgcatagtctcgttcgtcaagagtcgctggtgtcttaccattttccctttcccaattaatgtaacgatgaatgttgcaatcaatccggctatcatactgcgtatctcccaaaattatttgaagccaaaattcatctgggcaaaaactatggctaaacaatttctggtaacggagatccgtatcccagattttgattgcgtattctaaagcatctcgtggtacatctatccattcttgtccagaaaaaacatctccatccctaaagccatatttttttaggcgatttacacgaatcaagcgttgtgttactagcaagacacggtgatagacttttccaaacgttgatcgtcgattaacttgatcgtaattaaaccaaaacttcatccaccataacagaggttctccactttttttggcatcaccaactcgataaaaatccatgtaaattcgttggttattttcaaaataatcgtaaatttttcgcgggtcttgtaggggccaatcttgtccagatattagatgaacgtatgagattgacggagatttcaaagcccatttcattagatcaaccgtcgcccgaacaatattaaagcttccccacttaacatcatacttagaaaaataatgaacccttttattagtatcaagctcttctttggcttcactactaagtgccatcttttgatcgatatggatataaacttcaaatgtcccagttagtgtggaaactaactttaacaattgcccctcattttcgtgggctaatataagaactgcttgcactattctacattcctatttcttgttctaatgtctttaccgctctaattatgaactctccacgtcggagtttttgtgccaatttcattgcgttagttctcattattttatagtcatcagctgacgtttccatcagaactttatctaaatccgctaaggaatttaatgtaattcctaccttatgttcttcaacaaaatccgccaatgcagcctctttccagatgattaccggtataccacaacttaggtacaaagatgttttatgcgggttattgaactttaaatactcaccgtatcgaccattacacccatcaagactggttccatcccacaccaacccaaaattttggtccatatgatctaataactcattaggagtatactgcccaacataagtgactccttcttgatatacattagccggattagcaccaaaaatcttcaatttagcttgagttaaccgaatcttttccaaaaaaggggccttctctaagtttcctgcaaaacaaacggatcggtcgtaaagatgccccccagttaaggtatggtcattatcataatcaaagattccgagggtagagactggaactttcaatcccttcttttctaaccacgtagccatatgctgattatgagttataaccccatccgttttatttagttgcctaatttcttgatgttctaattcttcactacgttcctctgcacgtagagcatcgatatcgtgagtaatgaaaaaaagcttcgcatgggtgtattttcgaacggcttgaatgatctgatcaaccaaataatatgagaaaatcgggtactggaagattacctcatcgatctcttgtcccttaaataatttaggaagatcataatacgcatatttaaattttccaaattttgatcgaacattgaacggtaaagtccagttttcatatccttgttgtcccaagaacttaatcatatccatctgtgcttttggaccggcattgttatctttattgtaaaaaaccgtcactatgacttttctcatttggattctcctttttctttgaccacgtcattgcaaatgttgctaataagaacgggttaaaagaaatatctagtaaatgttgctccactaagcaacttatggtaacgaccaacatggccactactaaagcataatctttctccactgttgctcgtattgaaatatacatcatgaacgcaacaatcatcactagaacaactagtccatagatcacaagtaaccgtacatacgatgaatcaatgtagaaatagcgtgccgagtctacgctcgccatttttagtcccttcgctcccccccatccgtgttcaatcacgtgatttccccacaaattggccccgtacttttttatcgccatcgacgacaaagcaagtcgattggaaaagaggttgtttgctctgataaataattgattccacggatcatagtttaaaacagcaactaagtcaataaaaactagaatcggggttgccgtccaaaataatgatactatttttattgcccatcgcttcttattttgtgcttgttttgcaacgatcaacgctatcactagcacaattgctgcaatagtgcttaaacgtgcatccgcaacttgtttcattaggtatgcaagaactatgaagacaacataatacggccaccgaattttatcgaaatcaagataacttttagcaatcattaaatataaaacatgagaggccaggtctgtcgggtacacgattcctaatgcatatctcgttccacggttaggaaccacgtacgatagatttgaaatcacaccaattaaagaatacagaactacggcaaccaacattatcaaactaattcgataataccagtgaactaccctcttaaaatgaactcctttcgcacccacaataagagtaacaacatccaaaatcaaatatgactgtgactttcgccatgaaatgactgcaaatgctaaaataagagtaattataagtagcattctaatattatggtgatcaaaaagatatatctttaaaataaccaaagcgacacttaaatacgataagagctgcaatggtctcgtatggaagtaatcagtaaacgtggtagtcattaaaaaagagatgaataacaagaaggaaaatgctattaaatagacttgttctcccgttattggtgtgcttattactcgttttacataacttttcatcaatattcccctacaaaaagagcacagttaactaacttatttagttaaccatgcctctcattaatttttatcggttattcccaagcggtttgtcaaatgacgaataacggcccttcgggttaaatcacctgtattaaataccgtcaaatacttaactttaaattcttggtggtaatttaagtatacgttaagtaaccgttccgctaagaatccatataatcggcgttggtaagtgtcgtaattcgtcatatctgtatgcttttgaacttcaaacaggatatcaaacaaccattgacaatacctatccatttgttgacgacgcgtgtaaaacatattatagggagccattacggcaggcccatccattgttctatcaaaggcgcttaaatattcaggatacagcttttcgattgcttcgcgagtatgcttcaaatctacctcatagtgtccccgaacgtattgctccttcagggtttctttccccttcgcatcatcctctggatacgcaactacccactcgtgctgggacaacattccctgaagctccttttccgttgctggtcgcgttttccctactagcaatagccataaatacatggcgtttcgaccaccgattcgccttccaaacgagtgtggagagaaataacgacgatagtgactaagcccaatatactcatcactagtgtttttccacatccaatacagcccggttaactcattgaactccttattttggctagaaatattctctcccgtattatcaacttgataacctcgttggttcgcattaaattctgctccgacaagcaatggctggtaacccttggggaggtcgtagtcaaacattttgtgtgctattacatatatggtcatgatctcgcctacttaataaggtgtttaaacgttgttagcacaaaggcgattaccattcctaaaagggcccctaaggcaaaacccagaatggcatacttttttgctgaaggtgtagtctcactcttagcatccgaagtataagcctttgagagaagttttacctgccccattccagccttcatctttggcaattcctgcttggcggcttcagctactgcgttgacaatcacagtagcatctttagcttctccggccttagcgtgaatatcaaggattacctcaccaatccgattttttgaatcaactgccgattgtaagtcggcaactgaatacttcctttgtaaactctttggtaattttttcctagcttgtgccatcacttggcgatcctgaattaaatccgcataagtctgcatcatatccatatctgccattgcctgtgaatttttataatcaactctctctaaattatggctaatcagcattgatcgctctgccgtgtaggttgtggtctgtttatgcttagcataaaagcctaatccccccatcccaacaaaagccagcactaagattagaatgatgtttttaaagataattttagaaatgtcatttatactgtatgatttgctcatttatcttctcctatgcgtgtcccgtgatcttacgttggataaacttaccaccctttttcaaccagttggtatgctccataaagacgtagttaacttctttggtcttgtactctgggtggacctccaaccatacgtccaagagtagctcgctcaagaatccgtagacccgctgttcgtaggttgagtagttagagatatcagtttgggcttccactttagctaaaacgtcgtacatccaagtgcagtactcattgaggggctttttcttcataatgaacatgttaaacatgtgtgcccaagtccgcttcatcactagctcaaaggctggtgcatactctgggtattgctcttgtatcacctggcgcatcacctcaaatggttcgtggtggtgagcatgtaagtaatgcgattcgttagtctcgatgtagtacttccgcttagatggcaggataatatcgtagtcttctaatagcgccacggtttctttttccgacagcaccgtttgaagcgacttatggtgacgtagactcaggtaacggcggtagtgcaccaaccccatggcatctacgtctaagttcttccaaccccagtaaatggcggttagctcgttataagtcgggttcttttgggaaatgttatcgcccgtgttatccccttggaaggtgtggttaacatctgggtgtaggtccttacccacaaaaaccggcagatacattggatctgtcggcatctcgtaatttttgtgggcggcaactaatacttttactcgcacaatgttctcctttagtaggctccgtttggtttgatcattactttcacggtttcaagcatgatctttaaatccaaccacacggagcgattttgaatgtaggttaggtcgaggcggaccatttcgtcaaagtccacgtcgtttcggccccccacttgccacattccggtggccccaggggtcactaagaggcgttgcttgtcgtactccgtgtactgctccacctccgaaaccagtggcggccggggcccaacgatgctcattgatccggtcaccacgttaattaactgtggcaactcatccaagctgtacttacgaatcacacggccaacccgggtgatccgggggtcgtccttcattttaaacatcgccccatcaacctcgttttgatcttgtaatttggcgaggagctcatctgcgttactaaccattgagcggaacttgatgattttgaattcgtgtccgtccttccccacccgggtttgggtgtaaaacaccggcccgtggggatcatcaactttgatgcaaattgcaatgattaacagtaccggactgatgaccaccaccccgattgccgaggccaccacgtcaaacagacgcttgatcccccggtaaaagtattggcggtttaatcgttccgcatcaatgtgaatcatgttttcaaccattagcgtttctctcgatttcaaattaacttgggctctctagtcgccccatttttcacttcattgttgataaccgcaacccattgtaaatagattctatttacaaatactcctctaatgataccaataaattagggcgttaaaaagaacttttcgtccggaacccctttcatcagttgttaaggttttcttgcttggccagccactgatcaatttcatcgaggtcaaaccccttgcggtaaagggcctgcttagtcttcatctttcgttcataaccttcaaaccggcggtaacggtgccaagctttttccgcttcccgttccagtaattccgcctggcgatcctccgtttgggacgggatttcgttttccttcaccagttggtaaacttcatcgccgtacccttgggttagcaccccctggtggattttttcgcttcggcgccgtgccggttggttcaggtaacgcttggccagcttttgcaccagtttggcggcattttcaacctgttgttccgtggtgaactgggtaagggcgtcgtcaattaaaaactcgcccacccgcttttgacgaagtttttggcgaatcacccccggtcccttcaaaccggtattcatctccgtccgcacgtaagcagccgcgtactcccggtcatccaacaagcggttttcccgcaacttggccatcaccaccgggacaaactccggtggggtgtcaatctccactagcttttgttccacctcgtgttcggtccgcagttggtgggacaagtaatccagcatcttattataggcttgcgccacctgatcatcgtttgagatctgctgtagtaatttctgatcgacctccatccccttataaagacggtacttgatcaagacactctcggccaccggaaaggcgtactgaccgtttaaaaagacgttaaagcgccccggtcgtttttgggccacaatggcggtaatttgtcgaatttgcgattctttttccatgatccacccttacaaattttcgcttggtttctatgtataaggtgtaagcagtgatcacaacttacaccaatcaaatttaaaggagatatcaacatgcttcataacgtcaaatccactaagcttcaagttaccttaatcgatggcgatcaccccgaaggtttgaaccgggtctttaacaacctggttgcccaaccgagtgatgagcagatcgccagcttccaaaccatccttgaaggattagccgggggtaccgtccaagaagccaccctgacgaccgccacgactttaactaacgaatagccataaccactagccaaccgaaaggaagtacttaaatgaagaccttaaacctcacctacaagggcagcctaaacaagacgcacatcttgaagatcaactacgccaatggccaactggacgaagcaaccgttcgccaagccatgacccagatcgccaacctaaagctgtttaagaagggcgaagaagatctgttcgtcacgcccgtttccgctaaggtggtcaacaccgacgaagaagtactctttgcttaattgctaacgaccagaggctgggagaaaaccgtgttttctcctagccttttgctgtattcacgaaagttaggcaggaaatgtggaaaataaccgcaggtctagtgcctaagtacggccgaagaacagtgcatactgcactaaccgttcgtcctagcttagtcatacgacctgccgagtaggttatttcccacccacttttttgattcgttcatgaacccactgccaaaagtaggggcgttggctaactggtccatccaccagcacctggcaggtagcgttgacaatcgccccgatcatcacaatcatcccggaaaagtccaaccacatcatcatcaaaatgaaggccccgatcgtcttgtaggaatttaaccgttgggcgaatacgacggcgtaataggagaagaggcgcgataggcccatccacagcaaggtggcaaccagggcgccaattaccacgtaccgcaggcgcacccgggcgttaggaacgaagtaatagagcagggttaagaagataaagagcccgccaaaggtcactggccaccgcaggctactaaagagggtgacgtaattaattgggaagtgcaagattggctgtaaggcttctagcacctgttccccgagaccatacataatcactaaggcaaagataatcatgatgacgatgatcatccaaataaaggacaggacccggttaatgatcggattttggttcttagccaccccgtaggcaccgttgacggagcgttgaaaggccgcaattccttggctagttgaccacagggccaccaaggccccggtagtcaggatccccccactcccccggcgtaagaaatcaaaaatgatcggccggataaattggtagaccgaactagggattgccgattgcagatacgggaggaccgtttttgcatctaaccccagcatcggtaagaggtttcccaccactagcaccgccgggaaaatggaaagtaaggtatagtaggccagcacggccgccgaagttgttacttgcgccatttggaagtgttcggcaaagaccgtcacaaagcgcttcaatttggtgccaataaatttcatcatggccctcccacacgttaataggcccattttagcagtttctaacggcgaaaacaaaaagaactcccgtgaggaactcttttgtctttctagctgtgcattatttcttgacgattccgctcactttcctacttcatcatgtgcaactggtacaggtactgcttaccggccgtcaaatcgtattgaaccagcttgtaatcttgccagagtcgtttttgcttcttagttaactggctgtacttaaccacttgccccttactgtttgtgaactggaggctagcagtactattgttttgaccagtgttaatggaaacggctggtaagtcctcatatacctttgtcatcaaagcaaggtatggcgtgaccttggaattagtttgttccgctaccatcgccatgaagtcattcgggctaaccaccttagtgttactggtcaaagtccgggcaccgtgttcacgggcgtaggtgttggagtagatgaagtaatccgtttcatgcagcttggtcccatcctttgccatgctgttgttgtaaatccccggcagatggtcaccatagaagacaaccgtgattggcttttggatcttgttaatctgcttgatgaactgcttaactgctttgtcggtgtaggtaagccccgttgtatacgttgcaaccgtccccttatctgtcccttcacttaccgaagttgggagccacttggagtagtttttatagtactgagtatcataaggcatatggttttgcatcgtgaccaagttgataaaggtaccgtttttatcagccttcagttgcgtcaaagcattcgcataagacgtttcatcagacagatatgggcttttaccgatctttttcttatctataattttgtacttacttcccagatagtaaaaacggttgaagccaaatttagcataatccgcgacccgactgtagaacaccccttggtacgggtgaattccaacggcatagtcaaacaattgattaaaggtccagtttttcgttaaacgtggcacgatctgggtatatggggtttgcaatgttgacgagaagttagccgttgccaatccccttaaggtcatgtattccatgttggccgttcccccaccgtaacctgaggacatcatcaggccactggtggtcgttttcttcaaggaaagaatatatggaatcgggtttcccttgatcttaactcccggcacccgcttggggttagagaagctttcactcaggttaaacatgattgtttgcgatgatagcgaatttttccgatctttgtttatctcctctgccaccacttgatattctcgggcaatcttttccatccgggctttcgaatagccggctggcttttccatcacggtgatgtcgatattattcaggaactggatgatgggtccattttctcgtgctccgtcttgttggttgtaaaaaattggatgatcccctagcccctcaataactgtactaatccttgagtcggtgtggttccaaaagatgctacttccaaagaaaaggacggtgagcacagtccaaatacaacgtctttttgtacttggggcgggaacaggtaattttcgatctaggtaaatccctagtccaattgtaattacgtagacaactgcacctgtgatcggaatccatgcactcactaatttaagcatgtttccgtatgcttgatacatcatcacgtctgacggaaggatcggctcttccctagttatcaacttaatccgattagcaatcccccatattatgataagggggaccacaatcgatagtgctagccaatacctcttcaccagtgattgaactagcttgaaaactagccaaattaataaggccgtaaaaagcagtgtcccctggcgagcagttaaaaggtagatatagttatcaaaggtcattgaaccagctggatttactttccaacttgtaaacatcaacaggttcgaaattaccgccaacccatacgctaccccgaccaccgtcaaggctggccagtgacgatggcaaaacttcttcagccacgctggccactccatcaagtgggacggcagctcctcaacccaccgctcgtaatgttgggtgatcgctaaagatgaaaagagccttcttaagcaccaattagccacgaatccgaccaccataacggcacccgcaatgatcgctaccaaaaggatcttcaagcccagattaccgacgtggccagcggcaaagccaacataatggctccgcaataaaggcagtcctgccaaaacaaggctactgtagatccctccgtttaaaatttggtgctcaccgataacctggttcttctgtaagagaaacatccccagtgccaccagcaccaataagccatctgataggttagagaaacggtttgccgttgacatatcatagtgaatcgttactgaaattgtcggcattaacattgccaacaccgccgttaccagcagggttaccgttccccaacgtttcacaaaccggcgccagtggtccggcagttcgatcccatcaaaggcggcgccgaccatcatcaccattaggtaaaagaggacgttttggctgtctttgatcccccacaaatcgttgtaaaagaccgtcgcaaccagaaacatccccactagtacttttccgaggaagcgtcggttaacttcggacagttcattaacccgcggaaaggtcgccatggcgataatgtaggccgttgccagcggaaagatattccgggtgattgggaaaacggcgtttaaaaggtcgctgaagtaaaactggttcttccaaactagttgaaggaggactgaaccggccccataggccaccaggactaaccaggtggtgatgacgcgggtgcggccaagccggtgtcgcttcaaagttcgcccaagttgcattaacagccacagctcggcaataatcaaaatcacgtggactaactggagaaccgccatcttgaggttgttttccgagtaattactaaactgaagttgtgaatcccacatccagaggttcatcaccgtcaagagaagggcgattagccaaccagagttcgctattatttttttcatgttactacctttataaaaagtggggttgaaagaaaataaccgtttcttccaacccctaattctattttattgtcccctagataacgtggaaaacctccgtagccccaccacctaaggccggcctacattgaagagtggttttcccccccaattatctattcttcgtacttcttggccacccgccgtgcaatctcgccgtagtgggccaattccttggcgtactcatcatcgtacaggtacttggcgtccgcttccggatcttgggaggtcaggatctttggcccgtcctccgtaattaccagggtgtgctcgtattggcacgaccagccaccgtcggccgtcttagccagccagccagacggatcggaggtgtcggcttgccaagtgccggtgttaatcatcggttccaccgtgatcgtcatccccttgcgtaggcgtaggccgtggccggcttccccgtagtgaggtaccattgggtcttcgtgcatcgtgggtccgattccgtggccaacaaattccttgacgtccccgtagccattttcgtcttcggtgtagtgctgaattacggcaccaatgtcaccaatccggttgcccggtacgcactggtcaatccccatgtacaaggacttcttagtgacgtccatcagcttgacaatctccggtgacggggtgcccacggcgtacgaccagcaagaatcggaaaaggcgccgtcgaggttgaccaccgtgtcgaccttaactagatcgccatcctttaagatcaacttcttgcgcggaaaaccgtgacagatttcatcgttaacactcacacaggttgcgtacttgtacccttcaaagccgatttgagcggcgatcgcccccgcttgcttgaagtaatcacgggcaaattcttcgattacccagctcgaaatgcccggccgaataatcttttgaatccccaggtgcatcccggctaaaacggcgccggacttttccatcgcacggatttcccgtggtgattttaagctaatcattcacactactccttacattttataaactcttaccagtatagcactctttgaatgtgctatactatcgaaggttttaaaattacaaatcgttcaaatttttggagggataatcatggcaaaagcactcgtggtttacgccaccattaccggaaacaatgaggacgtcgccgacatggtcaccggcgccctggaggacctcggcgttgacgttgaaatgaccgaaatgacgatggccgacgtcgccgatttcgatgacgtcgacctttgcgtggtgtgcccctacacctacgacgaaggttccctacctgacgaagggctcgacttctttgatgacttaaaggaatccgacctagccggaaaggtctacggggtcgctggttctggtgacaccttctacggtgatgattactgcaaggccgttgacgaatttggcgccgcctttgaacaagcgggtgccaccaaggggagcgcaaacgtccacattaacctcgctcccgatgccgaagacgaggaacgcttggccagctttgccaaggacctcgtggccaagctaggctaggaggccgtcatgcgcaaactctggaacaagtacggccaagtgatcgcctacctcttttggggtgtggtcaccaccctggtcaacatcgtgtcgttccagttcctctcctcaggggtccactggaactaccaggtggccaatgtaacggcctggtttttatccgttttagttgcctacctcaccaacaaggtctgggtttttaactcccattacaccacttggaaggccttttggattgagatctcccagttcttcttttaccggggcctcaccctcttgatcgacatggccttcatgttcgtaggggtgaccttgttaaagctcaacaccccaatccaagaactaatggtgaagatcgttgataacgtggtggtcgtggtcgccaactacatcttctcgcggtggctgatctttaaggacaacgaaaaaattgctaagcggtagtagtcgctaaccaaataaactccggtcagtccgcgaaatgcgaattgaccggagttttcttttgaggaagtctttccaaatgtcatagggatcatataacaaacaagagttcttggttttatgctgaagttcccgtataatggaaaggcaggaagttataagggcggtggctgtcttttcctggtgaggtgaggtctatggaaacatggaagaatcttcagaaaggtttcacagctaatgagtgtctttcgggcacttacgttgatgctgatgtttggcacgtttgtactaacgttgctagattacatcaaaaagcatcacaaatagaaaaagccgtcccacattataactttggacgagttatgggacgactttagattctcgtaacaacgccatcgcctttctagcgacctgcgtcggagtcctgttggcgcagggctcctttttgtatcttcattatagcacgaaataccaaattgggagaattagttgcctttgtttacggctaacctattgctcttatggtcccacccggaatcgaaccgggatcaatcgcttaggaggcggacgtactatccaattatactatgggaccaacacaagaaaaattatcgcattctttaccggacttgtaaaggtgcgatcatcttcttgttacttttgttgctcttcgtttttgcgccggtgcttcaagcgaatccccttgttcttgcggttcttctttttgtgcttggccttggcaggctggctgaaggaatctagcgtgcgtaccacttcttttttcgggttgcccttggcgtcgtgttgacgcttttgcaccgccttgacggtcgccttttcaaccgacttccccgcgttcttagcgtcctcgccggaaaccaactggcgcttgtcgatcgtcattggctccaactggtagtcggtgtcggccaaaagcttcttgaggtcgcggaagtcgtggtcgtccccaaggttgaccaccaggcccggttccccctggcgcccggtccggcccgtccggtgaacgtagccatccgccgtgttcggcagctcgaagttaaccaccgccgggagcttaggaatgtccaggccccgggccgccacgtccgttgtcaacaagagcttaacttggtgtttgcggaactggcgcatcaccgtttcccgttcggtttggcgctgccgcccgcccaaagtggctgatgaaataccgtcgtggcgcaagcggctggcggtgtagtggagagtcttaatgctagtgaaaaagaccagcgcccggaagttcttggtttgactgagccgttccagcatcaccgctttgtcactcatcgtccgggccaccaccaacccgtgcttaaccgggccgcgggagtgatcctgggcccgcacgtcaatcttgaccaggtcgcggccaaacaagacgtcgagctgttccaaggtcgttgattgggtggcggagaaaaaggccaactgggtgtctagtggcgttgcccgctcaatgtcttcgaccaccgcttgggtgtcgtcgcgcaagaggtcgtcagcttcgtcgatcaccaacgtggctaagttgtttaacttgaggtcacgggtgtctagcaggtgcaagatccgccccggcgtccccacgacgacttcagggcgctcctttttcaaccgttccgtttggcggcgcaggttagcgcccccggtcgcggagtggaccttaagccccagtaaggccgcccattcccgcatcacccgggtggtttgcagggccaattcctgtgacggttcgaggaccaggatttgggttccctgccccttcatcaccttgggtaacagcggccaggtgaaggccagggtcttccccgagccggtcggggcgatcccaaagacggtcttgtcctcttctaagggcttttggaccgcctcttgaatggcggtcagttgtttgaagttgcgttcttcaaagtgggtttgaaactgttcaatcaaatcaatcatcctctagcggttgttgtcagctggaaaagtgagctccgccgattcacgcaggttgtacatgacggcgttcacttcccggcttagggtttgccaacgcttgtagttggccacttgttctgggtcgtccggagcgttaaacagagcggcgaagtcgtttaattcatcgaccatcgagttttcaaagtacggcgcctcaagttccgttggttcctggttggcatcgaagtaggtcaccttggtggtgtcaaagatcgaatcaaagaccagggtgtcctttaggccgtagatttcagaaaccaggtgggagttagcggtcttaccgaagttcagggtcactgcaaactgatcgtaagttaagatggccgtccccattccgtcaacgccagacttggtcatagttgggaagtaaacgacgctgtccggcacgccaaacagggtcaccgccccataaacggcgtaaaccccgaggtccatcaaagcccccccggcaaattccggcgtgaagatgttcgggtacggcttctcgtcggctaggaccttgtcgtagcgcgaagagtacttcatcacggtgatgttcgccccttggatcgtgtccatcttctttaattggtcttcaccagcgtggaagaggccggtgtgaatgtggcgcgcggcttcgaccaggcgggccttggggtgggcggctagcaacgattcaatccggctgaattcttccgggttgacgaaggctggcttttctaggatcacaaacttatcgttttcgatcgccaggcgggcctgttcgtagtgcttgctgtttggtgaggcgatgtaaaccacgtcaaagtcgccttcaccaaagaagtcctccagcgagtcgtagaaggcggtggcgccgtacggttccccgtattccttggcccgggtcagggtccgggagtagaccgccgtcaattggtattgaccagtcgtcttagcggcgtctaacatttgatcggtaataatgttggttccaataattccaagcttgagcatcgtaaattctccttttttctcatgttactactattttaacaacttcccctggtttttaacagaaatgaaatcttttctcatcaacattctgtgtataatatatgttgtttaaagccgatgctatcgaatgataaggcaagtttataaagtggggagtatgtaaaatgcggaaaaagggaatgttactgttcggcgcgggactaatggctggaatcactagttcgcttggtttcagccactcaaaaaagaaaaacgaacgttcaacctccttaccgatcttttacgccggcacctggcgctattacgatgaggagcgggaccggacccacgtcattaccatctcacctgaactcgaattggggatcgataaccaggtgattccggctaacgttcaacacgttagcaccgatcaacttgtctacctcgataaatttggttaccacatcacgatcaaggccaacgagcagcggcccacccgcctgatcgatgaggcggacgaccaagaataccaaatcgaaccagtgcaataacataaaggggccgggaaggttagcttcccggcccctttttttatctactctcctctttctcctaacacacccaggggatttcccacttccgtttcgctgcggtataataaaaacatctgatttgcggaaaggaagaataggatgttaaaacgattagcagtgtattgcggcgcccgcgctgggcaggacccttcctttatggaaatggcaactgactttggccaccagatggccgaacacgacgtcgccctggtttacggtggcggtcgcttcggtctcatgggggcggtggccgacgccgtcttggaagccggtggccaggcccacggggtgattaccgaagaactggccaaccggggcactagccacccggacctgaccagcctagaaatcgttgacgacatgaacacccgcaagaaccaaatgatggaaatggcggacggcttactcgccctccccggtggcctgggaaccctagaagaagttagcgaggccttttcctggaccgccctgggcgataacgctaagccggtcgccctctacaactaccgcaacttctaccaacccctaaaggacatgctagccacgatggagatgaccggctttaccgaaccgccctacgtcaacgcaattaagttcgccaccaactttgatgaggtcgccgacttcatgaatcattaccaggctccggcgatccgtacttacgaataactagccctgcatggccgtcaactgcgtcttaatcgcggtggcggccacttttagttgggcttcttcaaccgggtacaagcggggcaaccagaactggcccacccccgcccgggtaatttgggccgggaaggacatgtagcactgatactgcggctgatagaccgcaactggcagcacggtgctcccgttttgtaataaaacatccaggatcgccaacgcccacgagcacagagtgtaactgcccttgtcgaccgtcgtcaacacccggtactcctcttctcgaacgtccaccaagagcttggcggtatccagggaatggccgttaatcggctcctcaatcgaccgcccgttgacccggacgctcgaccagattggcaccaggttgccgtcgtgctggcccagcatgtagccggttaccgagctggccggttgctccaccgccgccgccaccacctggtgcaagcgggccgtatcggtaatcgtaccggtccccagtacccgctggaccggtaactgccactcttgttggatcaaaccggtcaaggcttcgttaggcgtcgccaagttcaagacccccccgctaaagccactttcggtaacggcggagcgccattcttgaattgcttggacgttgccggccagttgcgcaaacgaatccggttggcccaagaaacgctgcccaatcgtcaccaccaagacgtcagcggccttgagggcggccggatcttggattaccacttcacagtggggcgccgggctggcagccaggtcagcggccaggcccaccgcaacttgatcgtcttggtccaataatatcaggcggtcgacccggttggtggccgctaacagccgcgccagggtgactcctaagttagttaagccaatcacggcaatggttcgcatgatgattcctccaattaacaagcgtggccaatgaccttctcggcaggccggatgactaagctaggcctgcggtgattggccacgtcttctatactaagatttgaaactaataataaggggctgggaacccctgctcccagcccctatttgattggtcactttctttattcgttacccacttccgggaagaggtttagcaggtattgttgcggtccctcttctaggggcaggtccacgtccgccggcagcagttcctcgtggtcgcccacgttgaagcggaccccgtggtctaaccacacttggatccccagcacgattgccgcccggatcaattcctgggcggtcaccgagtaccctttagcgatcacggctaacggttggctggattgcaccagctccaagtaacggtcgttggccaccttcaggccaaaggaaagcatcatgccgttttccatcttggaagccatctgtccggcaatcgttaagctcgggtcttcaatccggcgttgaacaaacttcagggccaaccggtatttgcgcggggcgtcgtactcctcgcagaaggcttccagctggttgacgaaatcaagcccctcttctttcatccagtcctcctgggcggttggttcctggagagcggcctgctcgtttcgttcggtggcgacccttaccttgtcggccatgtcgtccggcgtttccgtcaggagggtgtagatcatgaccagttcgaggaagtttaaggtatcctctgagatcccggccttggagaacggatcggtgtcaaagccgcgcatcgagatgtattgaaccccatcgttgatcgttttttccaagttgctggtccgcccgtgcaaacagaccggcccaaagtactcgtggaagttttggtaggtgccgttttcaaggtagtcggccaagctgttgatgtaggcgtccaaagaactgtaatcaacctgctcgtttggtaagttggtgaagccatacttggaattacgcaaagaccggacctggtgttctaactccggcgccacgatgtctttgacgctggtcgccaccgggctggccccaaacaggtaagtaaagagccattgccaacggtaaaagccctgggcgagcttaaagtagaggtggttttggaaatcagcttggcgccggtacttgtcctggtagaagcggtggtagatttcctctagcagctgcttgtccaggccgtaaccgacgtgaactccccccatcaacagcgacttaatgccgtacttgccgactaggtagtggtaaaaatccttttggtcggggcgtgagcagttataactcaaaaaatcgaggtcgtccttgtagaccagggccgggggcatcgttaacggccacaagcgttcctggctttccatctggcggtcaacgatctgctgaaggatttgcagctggcggacggccgcctcgctccccttcataatcacggcgttgaattccatcagattatcagaaattccgctcgttaggtaggggtttttcacccgtgaacccagttgactcgggtaagggtaacggctcgcccgaccgtcagttaacacacggtgggcttgcatccgcatcccaaagcttcccgcaaataacttcgcccgtaattctggctcatgcattgcttctcgcattgccgcacatcgatccatcattgtcacctcacaaggcccgggggcccttttcaattaatttttcctcaaggagttcattatagcacttgtttttgaacgggcgacaccgttttcacgattaatcacgcaccgcccctacttaaacttgtgttgcataacggtcaaaatatgcaaaatgaccgacaggatggcaaagaaaatcaccacgaacaccgcccaggacagccagaaggtggctgcaacggctaagaaactgaagagccaggtttggagccccatcgtaatcagggtcaccaaggcaattgtaaagaataaaactatgtatctgaacacggttaaggtccacctctcttttacgtgcgggttggcaatttcttgacccagcttagttagctccgccaccttggcctgggggagttccttcatcttccaggtccccgtttgcaccgcttcgcccaccttaacgaggccggcatcgagcagcaccttatcgacctgttccaggggtgggttggaggcccgaaagataaagtttttgattgggccggcgtaacacgaagtcagcgatacgtaacgcttgccgacaaatttcccgggaaataaccgtccggtgtggtcctcacggtaaaagcggcgccggaaacagtcaaagaagtttttcaattgtccactcatgttccctagataagtgggtgatgagatgatccacacgtcagccgccagcagtttcttttctaactcccgcaacaccgggttggggtgccccggataatccggtccaatctggtaatccgccaggtagatggtctccacttcccacgccggatccattgttaacccggcggttgtcgccgccaacatctgtccggaaataccggtttgtttatgtgacgctaagattgctaacgctcgcatcgatctgccaccccctttttttcaattagggttattatagcaaattccgcactaagttgaaattgagccattcatttggcgcccgctggtaaatatgctatcctagggttaatttgaaaccgaatacaaaggagatttcgatatggtagtttctaagattagcatctcccccgaagcaagtaagtggttccgtgagggcatgggcgttcccgaaggtggcggggtccacttcttcggccgggtttacggtgaaaccaacgcccacgaagggttctcaaccgggatgagccggcacgaccaaccagttcagccactggtcgaccaagtcgttgacggtgttcactactacatcgaagaatcagaaaactggttctttgaaggcctcgacgtccaagtcgactacgacaagtccatcgacggccctgtttattactacacccctaacgacggctctaagctagacacccacgcccactcttccaagacggaaccgtaaggagtgagtgtgaaccagcccacttggcaggccgttgggctaagctagggcgaacggttggtgtggtacgcaccgttcttcgcccgtacttaggcactaggcctgcggctggtgagcacgttatcagagtgagtgtgaacctacctacttctccacgcttagccttttaggttataatggaaataccaaaggagccctgctgataacaggactccagcgcaggtcgctaaaaaggcactggcgttgttatatgtgacataaagtcgtcctataactgctcaaagttattttgtaggacggctttttctatttgtgatgcttcttgatgtaatccaacaacgttattacaaacgtgccgaacatcagcatcagggttagcgcctgaaagacgcgcagtacaacaaaagggctccagtagttcgctttacgaacccgactggagccctttattttacgggaaacatcaagaccaaggtttccccttttatagctgatactaaaacaccccctgggaacgtcgcgttcctgggggggttagtttattattcgtacagggcggccacttgttcttgggccgtcgggtgggccaaaaagtcatcgtaagtggtgtcggcgcggctcacaaagccgtttggtcccacttcaatcaggtggtcagcaatcgtttgaatgaattcgtggtcgtggctggtgaagaggatcgagcctgggaagctttccatggcgtcgtttagcgccgtgatcgattccaggtcgaggtggttggtcgggtcgtccatcaataagacgttggcgtgttgcaacatcatcttggataagaggcaccgcaccttttcgcccccggaaaggaccttgatttgcttgtcaatttcttccccggagaacagcatcttccctaagaagccgcgcaggaaggtattgtcgttttcctctttggtggcgaattggcgcaaccagtcaatgatcgtcaattcatcgttatcaaaggcggcgtttaagtcacgggacatgtagttagtagaggtcgtttggccccaggtaacggtcccttcgtccggcgttatttccccggcaataatttgcatcaagacggtcgtcgccatgtcgttgcgggacaagaaggccaccttttcgcccggccggatcaagaaggagacgtcgtttaacaacttttcgccgtcaacggtgtgggaaatgtgttccacctttaataggtcgtttcccagcgggcggtcctgttcaaacttgatgtaggggtacttacgcattgacggttggatgtcttctaaggtgatcttttccaactgcttcttacgggaagtggcctgcttgtgcttggaggcgttggccgagaagcgagcgatgaactcttggagctccttgatcttttcttccttcttagcgttttggttggcggctaattgggcagccagttggctagattcgtaccagaagtcgtagttccccacgtagagcttgatcttttggaagtctacgtcacacatctgggtgcagacttggtttaagaagtgacggtcgtgggagacgacgatcacgatcttatcgtagccggccaggaagtcttccagccaggcgatcgtgtgaacgtccagcccgttggtcggttcgtctagcaaaaggatgtctggcgagtcgaacagggcttgggccaagaggaccttcaccttgtcgctttcggccagttcacccatcaaggtgtcgtgtaggctttccggaatccccagtgattggaggagttgggaggcgttggcttcggcgttccagccgtccatttcggcaaattcggcttccagttcggccaccttcaccccgtcttcatcggagaagtccggcttggcgtagagggcgtctttttcttgcatgatttggtacagcttggcgtggccctgaatcacggtgtccatgaccgtgcagtcgtcaaaggcgaagtggtcctggtttaaggaggtcatccgttcgttagggccaatcgaaatcgtcccggtcgtcgggctcatcttcccttccaacagctttaagaaggtggacttgccggccccgttcgccccaatcaccccgtagcagttaccaggcgtgaacttgaggttaacgtcgcggtacaaggtccggcctgacaggttcaggctcaggtcagtaatggtaatcacgtgcaatttcctcgtgttttctaaaattttgctctcaccaatttagcacgaactaacgcttccgggcaagcctccctactcaatcaaaacgggcgtcatcaaaacttaatcttctttgaactactcccacttagctaagcctacggcttgacgcttgaagtgggagattctgggaacatcgcatacttactctaccggttctaagtgaactttcgagcaaactagcaactcattaagagcttaactagcttttatattatatcatctaaccattttgatgtcaagaacttttttaaagatctttgtgatcgttttggttatccgttgcatttgcaactcttgtagtatctcagagttgcaaatgattgtcaataacttttttaagctgatgaattatcataaccgcttgtcgtcgtgacaacgatattaaatataccgtgtcgaccccactatgtcaacggcttacgcaaactttttcgcccctctcaaatcataacgaacatttatctccctgatttatttttagttcgttttatgtctaatagagagacccctgagcacttatcgcccttttcgattcgttaaaatattaacattgcggattaaaagaattggaacttttttactaaaaaagctcaatcactcgcgttaccgaatgattgagcttttgatcatgagacggttttacaccgtcttattcttatctcacctatttctaggctacttctttggtcgcatcgttgggaataataagacgtcgcgaattgactttgcgtccgtcatcaacattaccatccggtcgattccgaccccgagcccaccggtaggcggcatcccgtattcgagtgcttcaacaaagtcctcgtcaatcggctgggcttcatcgttaccctcagcgttttcttgagcttgtgccttaaaacgcttgcgttgatcaattgggtcgtttaattcagagaaggcattcgcgtattccttacccaaaatgtacagttcaaaccggtcagtaaaacgggaatcctcttcgttaatctttgctaacggtgagacttctaccgggtgaccatagataaaaatcggttgttccaaggtatcttgaaccttttcttcaaagaaggcgttaataatgtgaccaaccttccaccaactctcgtatttaattccgttgtcatcagccagcttacgggcctcttcaacggtcatttcttgccagaagtcgattcccgttgcttccttaatggcatccaccatgtggagacgcttaaaggaggtactgaaatcgagttccgttccttggtaggtaatctttaagtcatcagcaactacaccagcggcagccttaaaaatcccttccgtttccttcatcacgtcgttgaagtcgaagtaagcggcgtaggtttccatcgtatcgaattcagggttgtggtacgggtccatcccttcgttacggaagatccgccccagttcgtaaactcgttccatcccgccgacaattaggcgcttaagccgtagttcggtggcaattcgcatgtacatatcaatgtttaaggcgttgtggtgggtcacaaacggccgcgcctcagccccggaggcaatgttttctaggatgggggtttccacctctaagaagccattatcgtccatgtaacggcgcacggctttaataatcttagtcctggtttggaaacgttcgaagctttcccggttagtgatcaggtccaagtaacgctgacggtagactaactctgggtcctgcaagccgtggtacttatccggcagcggacggagggccttggataaaaaggtaatcttttcggcccgcaccgtcagttcgcccatccgggttttgattacatcaccagtaatcccccagaaatcccctaagtcggattctttgaatagcttgtaggcttcttcccccaccatatcttggcgaacgtagaattggatcttgcctccccggtccaataggtcggcaaaggacgccttcccgcttccccgttttccgatcatccgtcccgcaatcgttacgacgttgtgttgggctaacagtagttcaccgctatcgttttcgtacttcttgcggatatccgtggataaatcgtggtccggatcaaaacggtgaccaaacggcgccaccccttggtcccttaatgcctgcatcttttcccgtcgaaccaccatctggtcgttcaaatgctcttcattcgccatttatcgtgcttcctcctagtttacgttttgttgtaattgacgttcttcgtactggtcaataaaccggtcaaagatctcgtccatttgtgcctgttcagtggcttccatcagggccaccttcgtccgggcggcccgcggaattcccttcatgtagtaagctgcttgcccgcggaattcccggaccccagcgtattcacccttcaggtccaccaggcgtgccaagtgctccttggccgtcgtgattttttcttccggcgttgcttccggcagtagttccccgttttctaagtagtgaaccgtctgcgtcagcatccacgggttccccatggcggcccgcccaatcataatggcatcggcaccggtgtattccaatacatacttggcttcttcagcagtcttaatgtctccgttagccataaacgggatcgtcagctggctggccacttccttcaagatatcccaatcagcgtgaccccggtacatttgcttacgggtccggccgtgcattgccaccgctgctacccctgcccgctgtgccgctagggcgttttccacggcaaagatgtgctggtcgtcccagcccgtccgcattttaacggttacgggcttttttacggcgtcggtcacgtaagaaaccatctcgtaaaccttgttggggtctaatagccaccgggaaccagcctcagtgttgacgatcttattaacggggcagcccatgttaatgtcgatcacatcggcatcggtgttttcgtcgacaaacttagcggcctccaccagggtctctttggtcccaccaaagatttgcagtcccatcgggtgttcgaccgggtcgacacccatcatttgcagggtctttttgttgtggtacataatcccgcggtcggaaatcatttccgaaaccacgtagccggcgccaaacttcttacagatcacccgaaaggcggtgttcatgaccccagccatcggtgccacaaccacttggttagggattgtgacgctcccgatcttccattccattcgttttcctcctaatttaaattaagcaattgcattgtatcgcaatgtttaaatcaatagcaagtcgtcgcctagtcttcaccgacatttacttagttgcaaccaagtacttgagttcttcttcgctgaagtggtacttgtgaccacaaaaacggcagacggcctcggccccgtggtcgttatcaatcatttcttgtaagtcgtccttggataaactggccaatgccttttcgaaccggtcctttgagcaatcacacttgtattcgaccggcatcttttcgaggatcttcaaatcacgaccggcaaagatcgtctccagaatctgttcgggcgttttcccttcccgtagcaggtcagacaccagcggtagttcccgtagcgtcgtttccaagtggttgatcgcttcgtcgcttgctcccggtagaacctggatcaaaaagcccccggcaacttcaatgtggtcatcggattggacaaagaccgacagtcccacggccgatggaatctgttctgactgggccaggtaataagtaaagtcatcacctaattcacccgaaaccaggttgacttccccggtgtacggggtcttatctcccggggccatcttggtcacggacagggtccccgtcttccctacggcacccgccacgtcaattttacccttggcatttaagggcaggtgaacgtggggattttgcatgtaggccttcaccgtcccctgggcggtcccgtcaacgacgataaagccgaccggcccgtcaccttggatcttgaccgtcatccccgcttccccttgcagacccgaggttgctaacagcaatgtcccgaccattgctcggcccagggctgcggaggccgcgctccaagtatcgtgaatttggtgggcttcttcaactagggccgttgcgttaacggcgtacgcccgaaattgaccgttttcggccacgctttttactaagtagtcttccattatttttcctccataagaaaagcgggtgcaacaactgtggtcacatccgctccccatttattccccaaccgcgggcttattcccggtgatcccaatcatctggttgatcagggtcggttggcttcttcgtttgatcggtttgatcagcttgcttgtcttgctcagcatccgttgcctgcggagtactttgctcatcaccctccgtttggctggtggtttgctcagcgtcttcttcggtcgcttcagccttagcgttttcacgccgttcaagttcgcgcttagattcctcgaaggtttgggcgtgttgttcatcttcggccgccaccacatcttcttctggcatcttcccggtcttgtaaagactgaggatttgcttttcatccagcgtttcgtacttcagcagggcttcggcaattaacttgtgctgttcgcggtgcgtctcgatgatgtgcagggcttgttcgtgcccttctaacaggatccggcgcacttcttgatcaaccaaggccgccgtttgttcggagtacggtgattgatcgtagccttgcccggtgaagacctgtccggagctctggagctcaaccggaccaatcttatcggacatcccgtattgagtaaccatggcgcgggcgatttgcgttgcctgttcaaagtcgttagaagcacccgacgactgggacttgaagataatctcttcggcggcccgaccacccatcaacccggcgatctgttcctcggcattcttcttagacatcagcatttcgtcttcacgcggcaacatgatggcgtacccgccggcgcgtccccgcggcacaatcgttaccttgtgaaccacccgggcgtcgtttaagaccaacccaacaatcgtgtgccccgcctcgtggtaggccacggtgttacgttcccgtggtgaaatgacccggtcacgcttggccggcccagcaatcacgcgatcctcagcctcatcgatgtcggcggcgtcaatttccgtccggtcacgccgggcagctaagagggcggcttcgttcagtaggttttcgaggtcggcccccacaaaacctggcgtttgcttagcgatttcctttaggtcgacgttacttgccaacggcttgttcttagcgtgaacgcgcagaatggcttcacggcccttaacgtcgggacgaccaaccaagatcttccggtcgaaccggcccggccgcaagagagcggggtctaagacgtcggaacggttggtggcggccattacgatgaccccttcgtccccttggaacccgtccatttcaaccagcaattggttcagggtttgctcacgttcgtcgtgaccaccacccatgccgttcccccggcggcgaccaacggcgtcgatttcatcaatgaagatgatcgacggtgcggtctttttagcttgttcgaacaggtcccggacccggctggccccaaccccaacgaacatttcaacgaagtccgaaccggagatggagaagaacggaacaccggcttctccggccacggccttagccaggagcgtcttcccggttcccggaggcccttctaagagcaccccggctgggatccgcgcccctaagcgcatgaacttcttggggttcttcaagaactcgacaatttcgaccagttcttgcttttcttcttcttccccggccacgtcggagaagcgaaccttgttttcctttgggtctgacggtttggtcttggtcttaccgaagttcatcaccccgcgaccgccaccgccttgaccagcttgccccatcatcatgtagaagaagaaaatcatgatgaccaggggaagaaccgtcactaacaggttcatccaaaggctattggattcttccgacttggttgaaacctccaccttttccttttcagcatacttctgtagctgggcgatggtgacgtcactttccagaaccgagctttcaaagttggtcgtggagcttgcactctgcccacctaaagaaaagcccgtcgtggaactcgatgacacaggctgcgctttacggtaagtcccggtgatccggtatactcccccatcaggctgcagctggaaacttttcaccttgtcactcttcagtgcggaaataaattcgctttgcgataagtttttactctgactggtggtactatttcccccaaacaggaaataagcaatccccataatgcaaagaaagattaccgaatagaagaggacgttatgggaaaatccattatttttccgattgttattcataacaacctcctatccaacagctgcacgttgttgtttttgtgaatggtcataatataccatatctgaccatcgctgactaataattagtcatcattcttttggtagacttccggcttcaaaacgccgacgtacgggaggttccggtagtaattttcgtagtccagaccatagccaaccaaaaattcgtggggaacgtcaaaaccaacataatcggtcgccacttcgacctcccgtccggccggcttatcaaagaaggtgcaaaccttaatgctcgtggccccacgcccttccagtagttccatcaaaaacttcagggtccgaccggtatcaacaatgtcttcgacgatgatgacgtccttgcccgcaatcgagtgctttaagtcgtgaagtaacttaacggtcccgctggacgccgtgcccccgtagtaactagaaacgtccacgaagtccatctccgcgtacagatcgatctttttaattaggtcgacggtaaacaaaaccgcccccgtcaaaacagatacgatcaccgggcgcttcccttggtaatcgttggtaatttgagcagccagttctgccactcgcgtttgaatctgctcctcgtcaaaaaggatccgttcgatgtcgttattcatgcttttcctctcaatatcattgttctcgttggcataacgctaccggtagcgcccctggtcggcggtcaaaccaagccaccttcaccccgactaaccacaccacttggcctaaggcgtcgacgatcacccgttggttcgcccgtaagtcacggggaaccttttggtcgatcaagacccgccgaacccgttggtgtgtgcccccctttaacaatagccggtcaccagcttgaacgggacggcaagtcaggggaaactggttgttagtcaaccaaaccgtggtcactgacccttggtctggctggcgggtgactgaaaaagccccccccgcccggagacgataccactggcccaattctaccacaaactccccctccgattcgccttcctgggccatttgcccggcttttttaaggaaggcctcccggtagcccttaaccaagcaccactgattgggcagttggaagctctggggcggcctggtttggtcgcctaacccggttaccagttggtgaagctgttcttctttaatcgttgcaacgccccgtttggttaggtagtagcggaggtaggaacgttgggtactttcactcaaccgacgaaaggcggccaacgaaaagccccgttcggtccgcagggtggcatcgagttcccctagtcgttcgttagccaagcccaagaggtcattgatttgctcggcgtcactagccagcgctgtgacgagccgggggttttcaacgctgaggcttggaaggtagcggtgccgaacccggttgcgaaacggggttagatcacggtttgtttcatcttcaaaccaggtcaactgatggtccttagcatagcggcggaggtcttgtttgttaagcgcgagtagagggcgaattagtgcgccactggcaaaggggcgctgccatctcagcgctcctaattgttcgatccgaccaccacgaattaacttcatcaggaccgtttccgccaggtcgtcttggtggtgcgccgttgccaccgcctgggcttggtatttgtccatcaccgtggcaaaaaaggagtagcgaaaccggcgggccgccgcttcaattcccttcgctgggtgctctgcgaccgcccactgggccacttcgaggggaaggtttcgttgccggcaatacgcacgtaaaaaggcttcttctgcggtgctttgggtacgcaagtggtggttaacgtgggcaacgattaaacggggacgccttaacttaggtaagttttggagcaggtctaagagcaccattgagtccaccccggttgagacggccacgactaaggtgttgcttgacgaaaaaaagcggctccccaggggggaccgctccatcgttaatttagggtctttcattagcttcgccggccaccccggccgccccgcttaccatcggtttgccgctttaaattcgacaaacgggattcactttccttaaggtaggaggatagcatgtcgttaaagtccccggacggcttgtgatggccaaaattcccccggccactgaagctacgagcgggacgggagaaaccacggggttcgtgatgacgattctggcggtcatcgtggccgtggcttaaccgctcacttggttgctgatcgtggtgatcacgcttggccggctccgttggcgtagcctgcttcattgaaagggcgatcttgccgttgccttcaatcttcatgacctttaccatcaccttatcgccaaccgttaagacatcgtgaatgtctttgatgaacttatcggagacctggctgatgtgaacgagtcccgtcttattatctgctaaatcaataaacgctccaaagttcgtaattcccgaaacggtacccgaaacctttgcgccttcttcaagtgccatgaactaagcatttcctcctcatacgattctaattgttactaattgtaattgagtataacacaccctcgggtcctgacaagcgttgaaaagagaaaaatccctattcttgactaagaatagggatttttttaatcagcaaaattataaatcgtttcaccagtcttagagtagttgtacttggatctaatcaactgctcgaggtaatcctggttgtgtaacaacgaaatttgcttggttaacttcttgccggttgcctgcttttgcttgaggaccgtccgttgctggtcaatgttttggttgaccttggcgagggtttgcttgctttgccacagttggaaaccgagaatcagggccaccactaaaataatggagtacataatcttcgcccggcgaacgtgaacccggtagcgataccggcggttttccgctatccggcgggcgtaaatggtgtttagcgccgcaatacgatggtgtctcttttgcatacgaaccctcctttgcctattactagaaaaattataccaagatttccccgctagtgtccatgctttttgacgattcccatcacgaaatttattccttgccgaagtcttcggcgtagctttcctctaaaatttcgtacatcccggcggcctcgtccttcttagtcgtttccaccaactggttgacctgtaccttttcggtcttgttaccgaactcaatcgtcagtacgtcgccaaccctgacgtcgctggaagacttggccaccttgtcgttgatcatgatccgtccctgatcggcaatctttttggcaattgcccggcgtttaatgattcgtgatacctttaaaaacttatccaatctcattgcttggtttccccttcttgttcattgtttgcttcttgcactcgctgacccaattccctggtaagcgccagtagctggttcaaccagtcctgttccgtcatctttggttggattaccagccgtaaggaaatggcgccgtcctctttttcatccatggtggccttaaagcgggtcttggccagggcctggataatttgtggggcgttgatttttttactaccaaccaccgtaaagttgacgtaaatgttatcgcgcttgcgctcaatttcgcttagcattgcttggtcggcgtacagcttgatcgtcccgatcgttaataagttcgccaccggcgtttggtagtccccaaagcggtcaattaggtcaccagccaattcggtcagttcttcttcactcttggcccggcgaatctgcttgtacaattcgatcttttggcgctgatcgtcgacgtaagtacttggcaagtaggcttcgactccgagctcgacttcggcgttcgatttaaccggtcgcttctttccctgcttggtggccaccgcatcagctaacatctcggtgtacaagtcgtaaccaaccgaatcgatgaaaccgtgctgctgcttacccaggaggttaccggccccccggatcgacaggtcacgcatggcaatcttaaagcccgaccctagctcggtgaagtcccgaatggcagctaaccgcttttcaccctgttcagttagaaccttattttcctggtacatgaagtaagcgtaagccactcggttgctgcgaccgatccgcccccgaatctggtaaagttgggctagccccaagcgatcggcgtcttcgacaaagagggtgttaacgttagcgatatcgaccccggtttcgatgatcgaggtggttactaagacgtcgtactcaccgcggataaaatcgtacagcaccccttccaactcgttttcactcatctggccgtgaatgtagccaatccgggcttcgggaaccagctccgctaactgcgcgaccacccgttcaatgtcgtgaacccggttatgcaggtaatagacctgcccgccccgttgcatttcgcgcaggatcccatcccgaatcacggcgccgttttgttccaagacgtaggtttgaatcgggtaacggcccgtcggcggggtctctaagacggacaggtcccgcacccccatcatcgacatgtgcaaggtccgcgggatgggcgtcgccgtcagggttaagacatcgacgttggctttgagttgctttaagcgctccttgtgtttgacgccaaagcgctgttcttcgtcaacaatcaagagccccaggtccttaaactggacgtctttagataagatccggtgggtccccaccacgatatcaatttcgccgttcaaaagcccccggtcggtctcctttaattccttggcggtcttaaagcgtgacatcagggcaattgtgaccggaaagccttcaaagcgggccttcatcgtgtcgtagtgctgctgagctaagatggtggtggggaccaaaaaggcgacctgcttgcccccggcaacggccttgaagatggcacgcagggcgacctcggtcttgccgtaaccaacgtcaccgactaagagccggtccattggccgcgggcgttccatgtcagccttaatttcctggatgctttgtagttggtctttagtttcggcgtacgggaattcatcgtcaaacttctcttgcaagtagtcatccttgggaaaggcaaagcccttttcggtctcgcgcttggcgtaaaggtcgaccaagtcgtcggcaatgtcttcaattttggccgccacccgccgcttggttttggcccactcaacgccccctaagcggtttaagcggggcgtctttgattcagccgaaacgtacttttgaaccaggtttaactgggtaactggcacgaagatctgggcgttgtcgcggtaatctaacaccatgtaatcctggtgaacgccatcgacttccatcgtcttaatcccggcaaacaggccaatcccgtggttcacgtggaccacgtaatcgcccggctttaagtcggtgtaggacttgatccgctcggcattcgctaacttctgggcccgtggacggcggttcttaacctgtttgaacatttccgcctcggtaatcaccaccaagttggccgggggcatttcaaatccgttagctaaggtggccgccaccagctggacctggtgttccattagctggtcgggcgccgtttgaacaaccgccaccccaaagtctgctagggtagtggcgacttggtttcgacgttccgggctgttggccatgatcacaaccgttgccccctgggactgccagcgcttgagctcaccctttaaaaggtccaattgggaaaagaagcgctgcatctcccgcgttgctaagtcagagatctgcgccagtttgacttgtccaagccccttttgaaagagggctaggtaggtctgggggcccggtcgcttgggtagggtttccatcaccccgttatcaagggtggcgcccctgacccggtgtttagcggccaccttatccatcaaccaggcagtttcttgctccgtaattcgcttggctccctccttaatccgcccccagtcgtctaagaccaggttgcttttcgcgggtaggtagtcgagcaaggaggccggctgttcgtacacccggtcggcgtactccagcatttccactggtaactgccccgcgtccaaagcggagatgaccgggtcaaagaggccaaacagggcctggcgttcctcttcatccgccgtttgagctaagtggtggtaatcgtcttgcagctccccctttagctgggctaacttggcgggtggggcgatgaaatcggtagcgggcaagatcgtcaccgcccggatgttttcaacgctccgctggctttcggcgtcaaagtagcgtagggaatccacctcggtgtcaaagaggtcgatccgcaccgggtgggccgtgttcagggcgtaaatgtcgacaatcgacccccgcatggcaaagtccccgggttttaagaccatcttttggcgctgatagcccatcgccatcaactgggtccccaccgtagttggatcaagttcacccccgacttcgaccgtcagggtggcggcttggaaatcccccggtttgggcaggcgccggcgcagacccgccgcatccgtcacaacgacggccgcttggtctgccaaaagggtattgagggcctgaacccgttgcaagcggtagtcaggtgaagcggtcgccacttcggttgccaacacctcttcgaccggaaaggcaaagacctggtcctcaccaagcaggttttcaaggtcggcgaccagctcttgcatgtggtaaagactgtcgcacaccactaactgcgggtgtgacaactccccttgcagcgccgccaacaggagcgttttagccgacccggaaaccccggtaatcaactggcgctggccactatcaatgacctccttaatttttgaaaaggctggctgttgcttggccaactccgttaacttcacccgtgtctccccccactttaattgtattcattcattaactgatcaaaactagtcccttgcacccacttaatcagggcttgttcagcttgcagcaccgccccttcaaaaacggggcgctcctcggtgtcaaaccggccgaggacgtggctaaccacggagccaaacttagggtggtcgatccccaacttaacccggttaaactcgcgggtccccaggtggtcgattaacgacttaaggccgttgtggccccctgacgctcccctttgcttgagcttgatcttacccaccggcatgtctaagtcgtcgctaactacgattaggtcgtctaatgcgatatcgtagtactccattagtggcttaaccgcccgccccgactcgttcataaaggtcgttggcttgacaagcatcaccttttggccattaattaggcccgtaacggtaacggcttccaccttttcatgggtaaaagcccccaggtggaagtcgcgcgccagttgttcgaccaccataaagcccgcgttatggcgggtttcatcgtagcgggtgccgatatttcctaatccaacgatcattttcatattaatttcacctcatttagagctgtcgatccctcgtggatattacgttaaaggaacttagctcaattataccttaatagtggttgattcccaaagaatcgtatttttctctcatctagatctcatttagctattattttgtgctatgatggtatccggcattaacggcttaataaggagaaccaatatgatttttaattccctcatccaaccaaaggatcaactaacgaccctctctgaaaacgctactttggccgaggccctttccaccttggagaataccggttaccgttgcgttccgatcctggatgcaacggggaccctctttcggggcaatatctacaagatgcacctttaccgccacaagtcgcgcgggggcgacatgtccttgccggtgacgacgttgcttaaaaacgccaccaagttcatctcaaaggacgccgccttttataacgtctttttcaccatccgtgatttaccatacatcgccgttttggatgagaacaaccgcttttacggaatcttaacccataatcggctcttacaaatgctagcgaccgcttggaacgttaactccggctcctacgtcctctcggtagcggtccgcgacgaacgggggaccctggtagccatcgccaaggaaatcacccgcttttgtcaaatcgctaacgtcttgtcgatcagcccaaccaaggacgaaaaacaggttttaatcaccctacccgatggtgtaacccaagaaacggtcgacaaaattgtccggcgcttaaaccggaagaacttaccggtcatcgaaattgaaaacctccacccgaacctttagaacggaagcggcacgccttggcagtccgcctgactaagctaggcctccgggtggcctaaaacacccacttaataacagaaatagctggagatcacgtcgcttaaaacgttgatcttcagctattttttagttttatttctcaacggctaagcttacccggagcgcctggtcaacctggtccatcaccgctcggggtaggcgggtgacgagctgtttgagccgggtcttgtcgatcgtgcgaatctgctcacacaagattacggaatcatgagccagcccggcggccccttggttgagcttaacgtgagtggggaggcggtgtttttgcatccgggcggtaatggcaaccacgatcacggttgggctgtggcggttaccaacgttattttgtaccaccactaccggccggatcccgccctgttcggaccctaggactgggtttaagtcggcgtaatagacatcgccccgactgattttccgctccattgacacccctcctagcctaggtagcgccggtgaagccgggcacccatcccggtaagaatttcgtagttaatcgtgtgggcgtattccgccacgtcagttacggtgatttcttgatctaaggagcggcccatcaaaaccgcttcggtcccaaccgggtattccttaggcaggcgaaccatcatctggtccatgcaaacccggcccaagacctcacagcgctggccgtcaacgaggacgtaaaagccttgcatccggcggggatagccatcggcgtagcctaccggtagggtagccacccattcgtcttctttagcggtatacgttgccccgtaagaaaccgactcacccgcctttaattgcttaacgtaggttgtgtgggtcaccaaggaggttaccggttcgagcgggaaggattccttgattccgactcccgatgggttagccccgtacattgaaatccccatccgaatcgtgttggcgacgattgatttttggtgccacagcccggtggccgaattagccacgtgaacaaacggcggtcgtttcgttaccaccgccatgaagtcatcgaagcgggcccgttgccgctcaaagtaagtggcgtcctcttcgtcggcggtcgcaaaatgggtgaagatcccctcaaattcaaagcagggcgccgctactaattgcagggcttctttaaagtcctccggcgtggtaaagccaattcgtcccatcccggtgtctagggccaggtgaaccttgaggggttgcttgatcccctcttcttttgccagccgttggtagttctttaaccactctaggctccccaccgtcagggaaatgccttgggcggccgctaggggggcgtactcaactggggtaatgcccagcactaaaactaactcttgaatcccgctatcacgtaactcaattgcctcatcgagcagggccacgcaaaaaccttcgacccccgccctagctaaagctgacgccaccggtaccattccgttaccgtaggcgttggcctttacgaccgctaaaatccggctgccaggggctaattgttcccgttgcctttgtacatttgcccctagggccttgaggtcaacgacaaggtccgtttttcgtaaccgtgcacttaccattgttactcccctttttctaaaataacttccgtaaagactagctgaccggtgtgactgacgctagcgtgggcaggaccgtcaaacgggtggcttaccaccaccggttgccctaactcattatcgataatttcaacgtctaagaagctaacgtgccggccaatccccgtccccaacgccttagagtacgcctccttcaaagaaaaacggccggcaatgtactcgtagtagcgctggtttttgagggtcgctagctgggcttgttcgcccttcgttaacaccttgttgataaaggacggggtcttttcgaccgcccgcttgatccggtcaatctcggcgacgtcaatcccgatcccggcaatcatggtttaatcctcgcggcgccggttccggttgtttgaaaagcgccgcttacggtcaccattgaaacgccggtgaccatcgcccccgttccggtggaagttacggtgtgaattaccgtgcccgccgcgacggtagtttccaccgcgaccgttgcgattgcgacttggtagtggtcgttccggtgtgatcttgaccggtacttgactggcgtcgtctttagtcaggtcgtttaaaagggccgccaccaattcaacggcgtcgtacttttccaacaacttagcggcgtcttcgctgtaacggttggtcgtcggatcagccaccaaggaatcaatgtcgttgtaggcgctggccacttgaccacggaaggcttcttcttccgtcggtggcttcagcggtaacatccgggcccgggttaacttctcgatttcgtgcaggtaattcatttcgtttggcgtcacgaaggttaaagagacaccgtggtgcccggcccggcccgtccggccaatccggtgaacgtaagaatccgggtcagacgggatgtcgtagttgtaaacgtgggtcaccccggaaatgtctaagccccgggccgccacgtcggttgccactaagatgtccaagtggccctccttaaagcggcgcatgatcttgctgcgccggtcctgggtcaaatcaccgtgaatcccggcggcgttgtagccccgggcaatcagcccgcgggatagttcatcgacccgacgcttggtccggccaaagacgatcgtcaggtccgggtcttggacgtcgatcatccgggtcatgatgtcaaacttctcgtaatccttggcccgaacgtagtactgatccaccaggtcggtggtcagttccttagccttgatcttaacggtttgcgggtcgtgcataaattgaaccccaatccgcttaatttccggcggcatggtggccgaaaagagcagggtttggcgttcgcttggcgtttgcttgataatgtcttcgatgtcttctaaaaagcccatgttcaacatttcatcggcttcgtctaagactagtgtttgcaccccagataagtcgaccgttccgcggcgcaagtggtcacgcaaccgccccggcgtcccgaccaggatttggggattcttttctaaggaacggatttggcggcggatatcggcgcccccgtaaaccacttggaccttcacgcgcttttccttaccgaggcggaagagttcctcttcggtttggatggccaactcccgggtcggggagatgatcagggtttgaatcgccgggttttccacgtcaacgtgctcaatggttggcaggccaaacgctgccgtcttcccagtcccagtttgggcctggccgatcacgtccttgccggctaagaccatcgggatcgtttgttcttggatcggcgtggcctcttcgtaaccggagcgttggatcgccttgagcaacttgttggataaacctaattcactaaaatacaaatatttcacctcatgtgttcgattggtacaataaatcgaggttgggagaaactcgttttctcccaacctttttttaatttccgaatgttacatagcaatgtggtaactaactgatgaccaactggctcaccgcagtccgccaccctgggtttccactttgggtaggggccctacttttcgagttgggccaacaccttttctaaatgcagaccgtggctagcctttaataagaccacgtccccggtcgttaaactagcttgcaaagcgtcggtcagggccttgcgttgcgccgcttggtagtagtgcagttgccccgctgggtagcccgcctttaagagggcgtcttttaatgcgcccatctcgccaccaattaagtagacttcatctaagtgcccattcatgatggcgtcacaaagaccggcgtgcaagcgtgcggaagcctccccgagttctagcatgtcccctaagacggccacccgcttaccagcgaccggaatcgtggctagggtggctaaaacctctttaacggcggtggggttggagttataaacatcactcaagatccgttcaccgttagccccggccacccattcggagcggttttcggttagctcaacgttttgcagggcttgcttcatgttagcgggggtgacgtgcatcagcttgccgaccgtcattgcggccagggcgttgttgacgttgtactccccgaccagcggaatggtgaagacttcatccggccattggttaaccgtgaagctgacgtggtcaacgtccgggttaacgctagtggcgtagaggtcgtcatcaagctggcggccaaaggtcttagtctgttggctcaacttcgcggcccgttcccgcaatagcggttcgtcaccgtcataaacaaaggtcccgtcttcggccaaaccgtgggtgatctccatcttggcgtcggcgatcttatcgcggctaccaaagaattcgatgtgggcttccccaatcatcgtcaccaccgcaatatccggcgtcgtcaaccggcttaacaggtctaattgaccaaagcggtccatccccatttcaaccaccaccgcttcggtattggcttccatgttcaagagggtgaccggaacgccaatttcgttgttgaagttggcgtaggtcttaatgacgttcatttgggtcgccaggattgacgccaccatgtccttggtggtcgtcttcccgttacttcccgtcaccgccacgacaacggggttaatcttgtttaggtagtacttccccagttgttgcaaagctttaagggggtcatcaaccacgagccgtgggtacccatcagcgggatcataagggtgatctttagcccacagggtcgctttcgccccgttttcaaaagccttggccacgtattggtgaccatcttgttccccctttaagggcacaaacaagccccccgcttccaaattccgcgaatcgaaagcgacacttctcacctcaatgtctccccactgatcaacctgattgtgggcctgaattgcctgggcaatttcagctaagctcattttcatgggtcttaatcctcttcttaaatctgctaatcgcatcgtagtctaacaattgattatagcactgatcgcaggggaaggcgaacttgagacagtaaaagggagtgatcaccacaagtggcaaccactccctttgttgctagaaagcgtctttggcatttctaaccatcataatttttacattttttccaagcgttcgatccgtgcctccagtggcgggtgagtatcaaacaagcctgaaagactcttgtgacgggcgttttcctggggatcactgatgtacaacgcggcactggccgggtcgacgttttgcatcggctcggcgtgttgtaattgccgcagggcactaatcatcccctgggggttccgggttaactccactgccccggcatcggcctggtattcccgctgccgcgacagggccatctggaccattgtagctgctaggggcgccaagatgatcaagaggattgaaccgatgatggcaaagacgccaccggccccttcctcgcggtcatcgcgccggctactagccccaaaccacataaagttaccggcaaagttaactaacaaggagatcgccgccgtcagggctaaggcaatcgtttgtaagcgaatgtcgtagttgcgcacgtgggtcatttcgtgggccatgacgccttctaattcctcacggttcataatcgccagtaagccggtcgtggccgccaccgccgcgtgttgcgggttattaccggtcgcaaaggcgttgggactcgggtcgtcaatgatgaagacccgtggcatcggcacccgggccaccagcgccatgtcttcgacgatgtgccaaagctctggtgcttcatcggcggaatggatttcgcgggcgttattcatgctcattacgacgtcagtcgattggccgaccatgatcgagacgtagatcacggcgatcaccagcgcaatgatcaccccaccggtggccgtccccgcaaagaggtagccaaccgccgccccgattaaggcgaccaggaaaacaaagccggccatcaccaggatggtccggcgcttattcttagcaatttgttggtaaagcatcggcgtttacctaatcaaagctaaccttgggggcttccttagcgctttcgggaacctgcaggtattccatggcggtgaagtggtgaaccttagccaccatattggaggggaaggtttgaatccgggcgttaaaagtggcgaccgttgagttgtacagttgccgggagtaagcaatcttgttttcggtgttgctcaattcctccatcagcttcgtatactcagtggaggcctttaggtccggatagttttcggctacggcgtaaaccgagcccagggcctgggtcaggcggttagaaacgtccatcttttcttggtgggcgtcatccggcaggcttgccagttgagtccgcagactggtcaccttttctaaggtggcagcttcgtacttgctgtagcccttcaccgtctccaagaggttcgggatcaagtcgttacgccgttgcagctgcacgtcaatttgactccaagcttcttgagcgtgggtccggaggttaaccaaaccgttatacatcataacgtaggcaaccaccaataaaacaagaatcacaataataatgattgtggtcatcgttgtcctccttttgttcttgttactaaggctattttagcagttttccaaatccaagggaagccaaacgccgtccactagccccccagctaacttttctgtattatggaaatgaatttagaaaggacgtgacgttttgaaagtaatctttgtctgcctaggtaacatctgtcgctccccgatggccgaagcgatgttttaccaactactggtcactaaccacttaacggaccaggttagcgtttcttcgcgggccacttccagcgaagaagagggcaaccgtccccacccgggtacccgccaaattttagaagaacaccatttagatgaccggggccaccggtcaacgccgattaagcgccaagacttttacgacgccgacctaatcattggtatggacgccatgaacatgcgccacctgcggacaattgcccctaaaggagaacaagacaaggtccgtgccatcaacgacctgaccccgggccaccagggcgaaccaatccctgacccttggtacaccctacgctttgatgacacctacaacagcctcaaacggtccctcccttactggttggactacgtaaaggagcggttagactaaagctttccccactgctcgaaagttcacttagaaccggtagagtaagtatgcgatgttcccagaatctcccacttcaagcgtcaagccgtaggcttagctaagtgggagtagttcaacgtataataattgctaacttagcattgaaaatagcatcaggagactacgacatgaataagaagaaaatgattcgcctgacggccttagtaggggtcgccacggcaacgggggtagttgcggaggctaatcaagctcacgcagctaccaccacaactaccgagactactaaccaaaccaccaacgctagcgttgaaagtacccaagcggctgtcgatgctgcccaaagtacgtttgatactgcccagactagtgtggatagcgcccaagctaacgtcacgagcgcctctaacaacgtaacgtctgcgtcggcagccctctcgtccgcaattgccaataaggaagccgctacctcgaaaaacattgcgtcggcaactagtgccgtttcctcgcaagccgttgtagtggcatcggcctctcaggcggtcagtgagcaggcgggggtagttagcgcggctgctagcgttcaagctagtgcccaagcagaggcgactagtgcttcagctagcctttcttcttcctcggccaacgtcgctagtgctctgagtgctgctgaagctgctttgactagtgaccagtcaaccgccgctaataacctatcagccgctgagagtgcggcctcatccgccagtgcggcggtctcttctgatcaggcagcagttgacaatgctcaagcggccgtggctagtgctcaggccattgtggacgcagttgctgaagtgcagtcaagcgatgtaatcaacatgtcagtggcctacatcaccgctttaaagaactacttagcgaacccaagttccgcaaacgcagccgccttacaggaagtggcgaagggtgctgattatgtaaaagagttacaacaaaagttcaaatcagatgcatccttagacgtggtggtggacccaagtgacccaacggttcaagaagccctgtccgtttacgcggttaatttaatcaatcatctgcgtaatcagtacgggttgacgaccgcctttggtgccagtgccaacgctaacgtagcggcgatagactttgtcaaaaagtactacgatgacgaagactggaacatcttcggcaccaccggtagcgatggccaaggccacaacaaaaatggattagacgcctatgctgatcagctcaatactagcattgccgaagatgcgggttcagggctgacgacctgggtcaacggtaaggcaacgatggccaccaccacgctgcacaacttactttacgctgtctactccgacatcgccacaatgctctttgacgacgggggcaccaacaattggagccacgcccagtcaatctttgaagacgggacgatcctaggaactggcggctttaacaacgtatacctaggggtggcctttgataagtacgggtacgcccactacgaactttacaacgctacggaagggaaccaattaggtaacaatgcctacagcttagacgttcagacggccacccaagccctgctaaccaacgcccaggctagcctagcgtccgctaaagcgtccctccagaggatgaccaccaatttgatggtggcgaaggcggcggtggtcgccgcccaaaaccagttagcggctttggaaaatagttcagccaacgatttagtagccgtgacgaaggcgcggacgcaattagctagcgctgagaccagttaccaaaccgccctggctacctacaagcaaaaggaggaggccctaaaaaaggctggcgataacttggcggctgcccaagcgtcactggaagctgatcaagcaaccttagcaaccgccaaggccaagttagccgagttagaagaaacggtggctaacttaaccaacgccgatcagttactagcagccgcccaagccgcctacgagcaagcggttgctaatttgacgacggcgacggggaatttgggggctgctcaagttgacttagctaaggccgagtcacaactggctctggccgaagacacagctgaacaggcgaaggtccgggccgcaattgccgctcaagttgatcaacagcttaatgggtctaccgcaaacgaccgccagtcggcggggcaagacgcaacaagtttaaagactaacgggcgggcgctgacggcaacggtcgcaacggctagcgctgcaaaacagaagcagggcgccaatcaaggtcgcctaccgcaaactggtaatgacgaccaggaagcctccgcaatggcccttgttgggttaggaatgttggggctcacgaccggcttatatggttacaagaagaagaagataactgaatagccacttaatttaataatgaaaatcccggtagatacttaattatttatcgggattttttatcgacttgaaaataaaatgagattatttgccataaattggcgagaatttaaaatttagtctataatgttaagtgttactttaaaagttaatgagatcactttaactttggatgcgaattcatttctaaatcaaaccgattgccggttgaatctacaaaatgggagggaaatggatgaataagcaaaaaaataccgacaaggccttcttcgggcaaccccggggtctgtcgacgctgttctttacggaaatgtgggaacggttcagttactacgggatgcgtgccatcctgttgttctacatgtacttcgccgttaccaagggtggtctgggtatggaccaaaccacggcggcatcgatcatgtcgatctatggttccttagtttacttatccggggtggtcggcggttggctgtctgaccgggtttggggttcacgcaagaccgtcttttacggtgggatcttgatcatgtttgggcacatcgccctctccttaccatttggcgcaccggccctgtacgcttcaatcctcttgattgtttgcgggactgggctgttgaagccaaacgtttccgaaatggtcgggagcctttactcagaagacgataagcggcgtgacgccgggttctcgatgtttgtcttcgggattaacctgggggccgccgtggcaccgtgggccgttccgtgggcggccagtggcttcggacttaacctcttcgggagtgaacaaaacttccacgccgggttctccctagccgcgatcgggatgttctttgggttaatgcagtactacttcgacggaaagaagtacctgtccaaggacagcctgtacccggacgacccgattgacaaggaaagcctgcgcccaatcatcaactggacgattatcggcctggtggccttagcagtcatcctcggcttgatggcggcgatgggacaactcaacgttactaacatcattaacctgatcacctttgtagccatcatcttgccgatcatctactttatcatgatgatttccagcaagaaggtaaccaaggtggaacgttcccgggtgattgcgtacatgccgctgttcgttgcggccgccatcttctgggggattgaagaatccggttccgtggtcttggccctgtttgccgaacaacggacggtgctccacattgggggctggcactttgccgccgctaacttccagaccttaaaccccctgttcatcatgatcttaacgccattcttcgtttggctgtggggccgttggaagaaccaaccaagcgcccctggtaagttcaccgctgggttgatcatcgccgggttatcctacgtttggatggcaattccggggatgttgtacggcactgacggacgggtttccccgttctggctggttggttcctggttcatcgttgaaatcgccgaaatgctgatttcaccaattggactgtctgtaacgactaagctggccccgaaggccttcaagtcacaaatgatgtcaatgtggttcctggctaactccgccgggcaagccgttaacgcccaaatcgttaagtactactcgtcagcaaccgaagttccgtacttcttagccgttgggttagtctcgattgtctttgggatcatcctcttcttcttcatcaagcggatccatggcttgatggagggggtcgactaaataacataaaaagcgctctccaggtgggggcgctttttgcttgtctaaaaaggcggcagcgcccataataaagtcgtttaaaggagcgaaacgatgaaaattgccattagcagcgataaccacttagacgttaaccgggtggacgtagccgccaccatggaggcccaggccgcctggttgaaacaacaagaagtcgcccactattttttcttgggggatttatttaacgacttcacccggacccagtcctactttaaagaactagcggaccaactaccgggcgtggggattcattacctagctggtaatcacgatatgattaagggggcgagctttgcagaaatcgaagagaatgacgatccgtgctactttcaccgccgctacctcgatttgggtgctaactggcgggtggtgggcaataacggttggtacaactatgacttttccgtttaccacgatcagcccgcggaggtcgccaagtggaagcgggtttactggcttgattcaacaatcgaccaaccaatcagtgaccaagcacgcgaggatttggtgctagggcaagtcgccagtcaacttacggcagccaagcgggtcggcaaacgggttctctttttaacccactttgccccccgccaccaggctctgatggttaggccaaccaaggtcaagggaccgcgaatggagcgctcctttcaaatgattcgggccctgatgggggctgatcagttgggcgacttactcgaagcgagcggggtggtacaaacggcttattacggccacctccacggcctgcatccgacctttacccacggcggggtgacctacgtcaaccccgcggtcggcgtcaacaagaagcggatgaacgagtggcaacggccgacatttatggaacaatgggcctggcgaactaaaattgtcgatctggacaaaaaagtttgaaaaaggtcttgcaattatccggaaggttcggtaatataatattcgttgattgttaccaaacagtcatgaccttttcggaggagtagcgaagtctggttaaacgcgacggtctgtaaaaccgttccttttggttcggtggttcgaatccactctcctccattttattattgggctatagccaagtggtaaggcaacggtttttggtaccgtcatgcgctggttcgaacccagctagcccaactaattaaccgttccgggattccggagcggttttttgtttccaaagggggattttgatgccaaagcaaggaaaagtagctaaagccagtcgccaggtgcgaattaaaaacggcggagggaaggtcaagcgacaggggcgcttgattgacccggatcagttagagaattttttgctggttcgctacgccctgaccgcccggcgtcacattaatcctagtgagcgggagagttgccaacgcttcctccaggaagtagcgagccgcctgaacgggggcaacgtggtgatggaccaattcagcgcccggcttgtcggtgacttattgccccagctgccctggcagttctttatgcaagtagccaacaactggccaacgttgcgccaattcctcggccgggagttgccggccgtgccactacgagacaggctccgggtggcatccttaccgaccgaagcggagtttaacgaactgctagttgccaagttgacccgccaaattgcggcgctgaccctgttaaacaaggctaacagtgccgaccagcgggagatgctggcgaccgcgatgcaacaaaccctgtatcaaaacgggcaaattagctgggcccaggtgcgggtgctgtatgccccgctaggctatacggtgccagaaaacgttgatgacggcactaggcagtggcttttagacttagttaaggtttaaccgttcccgtttacggatccgcgggggcttgttatcatagacacaatacacgaattgatgagtagaaaggatggcacttgccatgcaaaagttctttaccgtacttggtgggatggggaccctggccaccgaaagttacatgcggattttagaccaacggacgccaactaattgtgaccaggattacctcgattacatcgtagttaaccacgccacggtaccggatcggaccagttggattttagatcacgatcaagaaagtccggtgccggttttagtcgaagacgtcaagcaacagagcttactgcaaccagagttctttgttttgatctgtaacaccgcccactacttttttaaggacttgcaagcggcaaccgaaattccgatcttaaacatgctagaagaaacggttaaggagatcaaaaagattaagccggatgctaaaaaggtggggctgttagccacgccggggacggtggaatccgggatttacgaccactacatccaagcggccggctacgaagagttgaagccgacccaagagattttagacgcaaccgaagacctgatctaccatgacatcaaggaggcggggcattccgatggtgccaagtaccacgagttagtccgtaagatggtggaagaacaaggggccgacgtcgtcattttgggctgcacggaactatcctacgctgaggagctgaacccggaaacgacctacccggtggccgattcgcaatccatcattgcggaccggaccttagagttggccctcaagtcgcaaaaggggcgttaaaacgagattaatcaacgggtaatggggaaccgaccacgaaaacgtgaatttcggggccccgttacccctttttgttgccaaatgtttggtagcccatattgacagtgttaaaatgaacatattgaattgattagcgtagtaagggggagcaagcatgggatcaccggtatacattcaaattcataaccaactacgggaaaacattgaaggcggtaagtggcaagtcggcgaaaagattccggccgagcgggaactggcggccgagtttggggtcagccgcatgaccctgcgccaggcgattcaaacccttgttgacgaaggggtgttggagcgtcgggtcgggtccgggaccttcgtggccagccgcaaggttcaagagaaaatggccggcgtcacctcctttaccgacctgatggaggggatgggcaaggtgccgtctagtaagaccatttcctatcacctgaccattccgtcgcaaagtgagatggaaaagttacagttaaagggtgacgagcaggtcttacggatggagcgaattcgctacgggaacgggattccgatctgctacgaggtggcaacgattcccgctcaactagtggcggacttttcaaaagaggaagtgacgacgtcttattaccggaccctggctgagcgctcgcacctctacccggggcacgccattcagaacgtttcggcaaccaacgccaccgaaaagatcgctgagtacctggatatcaagcgcggtgacgccctcttgcgaatgacgcagatttcttatttgcaggatgggcgcccctttgaatacgtccacacccagtacgtgggcagtcgctttgaatttgtcttggaaaaataaggccagactttaatttgtgaggaaaaacaaatggattacaactatcctgatgatagctatacgctacataccgacgcatacgaactctcgatgatgcagacctactataaaaaggggttggccaaccggaaggcggtctttgaagcctttttccggaagatgccctttgaaaatgggtacgccgttttcgccggtttggaacacatcatcacctacctaaagaacctccgcttttcaaagacggacattgactacctgaagacgaccgggcagtttgatgatgactttttggactacctggctaacttccggtttcaagggaccctgcgctcggtagttgaaggggagttggtctttaatcacgagccactcttacaagttgaaggtacgattatggaggggacgttggtagaaacggccctgttaaacatcatcaactaccaaatcatgattgctacgaaggccgcccgaattaagtcgatcgtcggcgaccaaacggtaatggagtttggctcgcggcgggcccaggaatttgacgcagctctgtggggaacccgggcagcctacattggcgggtttgattccaccagtaacgtccgggccggtaagctctttggcattccgatttccgggacccacgcccacgccctggtgcagacctaccgggatgaatacgaagccttcaaggcctacgccgaaactcaccacgactgcaccttcttggttgatacctttgacaccctgcgttccggggtgccgaatgccatccgggtggccaaggaatttggcgaccggatcaacttccaggggatccggattgactccggggacatggcttacctgtccaagaaggcccggaaaatgctggatgaggcgggctttaaggacgccaagattgtctgctccaacggcctcgacgaaaagacaatccaaaacctccagatgcagggggcaaaaattgacgtctgggggattggcaccaagctgatcaccgcttacgaccaaccaaccctgggggcggtttacaagcttactctagtggaagacgaaaccggtaagatggttaacaccatgaagttatccaacaacgtttccaagatgtccacgccgggtaagcaccaggtgtggcgaatcaccgaccgggtggacggcaaaagcgagggcgattacgtcaccttaagtggcgaagatccgcgccaactggactccttatacatgtttgacccgaactatactttcttgcacaagacggttaaggatttcgtggcccgaccgctcttgcaagacatcttcgttgatggccagctggtttacgagcagccagacttggagacgatccgggcttcccgggccacccacttagatcgcctctgggacgaatacaagcgggacttaaaccccgaagtttaccccgtcgacctctcccaaaagtgctacgacaacaagatggcaatgattcaagaaatccacgattacgtcgataagatttaagaggagtaaagcaaaaatgcgtcaattgcaagaacaaattattgaagacctcaaggtgatccccaccattgatccgcaggttgaggtacgacgccggatcgactttttaaaggactacctcaagcaaactaagatggcaaccctggtgctggggatttccggggggcaagattccgccttggcggggcgcttggcccaactggcggtcgaagaactgcgcaaggagtcggggagcgaagactaccagttcatcgccgttcgcctgccctatggggaacaagccgacgaatccgacgccatgatggcgattgacgatttcatccacccggaccgtgtggttaaggttaacattaagccggccactgacgcgatggtaatgacactggaagccgccgggactaagatttccgattttaacaaggggaacattaaggcccgcgaacggatgattgtccagtacgcaattgccggggaataccacggggcggtagtcgggaccgaccacgccgccgaagccgtaaccgggttttacaccaagtacggggatgggggtgccgacgtgacgccgctctcccaactcgataagcgccaggggcgggccctgttagagtacctcggggcgccggaaaagctttaccaaaagaccccaacggccgacctagaagaagaccggccggccttaccggacgaacaagccctgggggtaacctacaaggatatcgatgacttcttggagggccgggaggttgaccaagccgcggccgaaaagatcgaggcctggtaccaacggactggccacaagcgtcacatgccggttgctcccttagacacgtggtggaaggattaaagagtggaaacagaagtactaacccgggtgcaggctaagctcacccaattcaagggcgcccaagtgcgggtggcccttgatttattaaacgatggcaacacgatcccctttgtcgctcggtaccgcaaggaggcgacgggggcgttagacgaagtggccctacaaacgattcaagaacaggctaaaaaagagcaggaactctttgaccgcaaaaacgccgtgattaagttgatcgaggcggcggggaagttaacggcaccgctacaagaaaaaattcagggcgccgatgacttagccaccgttgaagacctgtacttaccgtacaagcaaaaacggcggaccaaggcccaagtggctaaggaaaacggtttgatgccgttagctaactggctgctcaagtatgagaccgcggacccgaaaacagaagcggcgcactacgttaatcaagaggtgccagacgctgaggcggccctggccggcgcgcacgaaattctcgccgaggggattgccgaaatggcgacggtgcgcagctggttgcgtaattacaccactgagcacggccggttagaagtcgccgtcaaaaaggacggggagcaacttgatgagcgaggcgtttacgagcagtactatgactttagcgagcaggttagccagcttagctcctaccagatcctagcgatcaaccggggggaaaaggagaaaatcctgcgggttaaggtggtggccgacccaactacggtaaccaactacctgaacttccgcctggtacgtggccaccagccaaacgccgcgaccgagttggtggaagcggcggccaaagacgcctacaagcgctttttgggaccggcgattgagcgggaggtgcgcactaagttaaccgaaggggccagcgcccgggcaatcaaggtctttgggcaaaacctctaccaccttttgatgcaagcaccgttaaagggccgggtggtgttaggttttgaccccgcctaccggaccgggtgcaagttggcggtgttagatccccacgggaaggtggaacaaattgccgtcatctacccccacaaacccgccccggaagctaagcgggcccaggccgaagcggagtttttggacctggtggaacgctaccaggtttcgacggtcgcaatcgggaacgggacggccagccgtgaatccgagcagtttgtggctacggccctgcaaaagcttagccggccagtctactacgtaattgtcaatgaagccggggcgtcggtctactcggcctcgccagccgccagagaagaattcccggacctgacggtggaaaagcggagcgccatttcaattgggcgccgcctccaggatccgttggcggaactggttaagattgatccgcaagccattggggtcggccagtaccaacacgacctcccggaaaaggagttagcgagtgagctcgacgccgttgttgaacgggccgttaaccgggtgggggttaatttgaacaccgcttcctaccagctactaacccggatttcggggttgaccaagacgattgcccaaaacatcgttgcttaccgcaatgataacggcgcctacacgaaccggaatcagttaaaaaaggttccccgcctcgggcccaaggcctttcaacaagcggtcggctttttacggatcgtcggtgggcaaaacccgctcgataacaccgatgtccacccggaaagctacccggtggccaagtcaattttggcggcggccgacgtaacggtgaccgagctgggcaccgagcaggccaacgcccggctggctaagcttcagccagcggacttcgtgtccgaaacggtcggcttagcaacggtaaaagacgtgctagaggccctgcaaaagccggggcgggacctacgcgacgggatgccggcgccgttactgcgtcaggacgtaatgacgatggatgacttaaagcccggcatgcaactagagggaacggtgcgcaacgtcgtcgacttcggcgcctttgttgacatcggggttaaacacgatggcttagtccacctatcgcggatggctaagaagtacccgaaggatccgcacagcctactggcggttggcgatatcgtcaccgtttgggtgcacgccgttgataaacagcgtgaccggattcagttgaccatgttgccaccaaagaagggtgacaatgactaaccaagagctccagaacctagtggaacggtggtcgcaagaaatctttgggcgcccctttttacaccaagcggtctttaaccggcgcttgaaaacaaccgggggccgctaccacttgggtgaccaccacattgatatcaaccccttgatgctagaggagtacgacctagcaaccctcaagcaggtggttctccatgagctatgtcattaccatctccacttaacgggacgggggtttggtcaccgcgatcgcgactttaaggccttgctaatgcaggtaggggggagccggtacgccccgccgacttccaaggcccggcgcccggggggagtggtagtttgtcaccgttaccggtgcacgggctgcggtctgatcatcgggcgcaaccggcgctttaacctggcccgcttcgtctgccgccgttgcggacaccgctttgaagaaatttaaaaaagttcttgctaacaagtagtatctttggtaagatgttatttgttgatgcggcggtggcggaactggcagacgcgcaagattaaggatcttgtggtcattgagaccgtggaggttcgagtcctcttcgccgcactacttaaggctctcggcagatgctgagggcttttttgtttggctaactaattaagctaataatatttactaaacttttaccaaaaacccttttaagttcttgtcgaaaccgttatcattaatggtaacgaacttaaggagggttatttttatggaagcagagctgaaatggttggacgacccagaagtttttcgggtcaatcaactgccggcccacagcgatcatcgcttttaccgggaccaagaagaagccgctttggaaaagagtagctacgttcagaatttaaatgggcgttggggctttaagttctccaagaacccaatggagcgccccgtcgacttttacaagcttgattttgatcgtaacgactttggtgagattgaagtgccaagtgaaatcgagctgagtaactttgcccagatcaactacaccaacatcacgatgccttggactgggaaaatttaccgccggcctgcctacaccctgggggataacaaggaagagggttcctttagccaggggcaagacaatacggtggggtcttacgtgcgccacttcaccctagcagagggtctcaaaaaccacgacgtccacgtggtctttgaaggggttgaacgggcgatgtacgtgtggttaaacggccactttatcggttacgccgaggattcctttaccccgtccgaatttgatttaacgccgtacttagtagatggcgataacctcttagccgttgaggtttacaagcacgctacctcttcttggattgaagaccaagacatgttccgcttctccgggatcttccgcgacgtcaacttggtggcccaaccaagcatccacgtccaagacttaaagatcaacgcccgggtggccgatggcatgaagaccgggagcctagggctggtgttgaagatggttggccaaccggggagcgttcaggttgaagtcgccgatcaaaccggggccgccgtgctcaaccgccagttaaacgccgatggcaactggacaatggcaccagttcaactggtggggattcacctgtgggataaccaccatccgtacctttaccaattaaccctgacggttcgtgacgccacgggccgggtcgtcgaagtaatcccataccagtttggcttccgccgggttgaaatcgaccaagacaaggtgctgcgtttaaacggtaagcgcctcatcatcaacggggtcaaccgccacgagtggaattgccaccggggccgggcggtgaccatagaagacatgcacaccgatttgggcatcttcaaggaaaataacatcaacgccgtgcggaccagccactacccagaccaaattccgtggtattacctgtgtgaccgggaaggcatctacatgatggcggaaaacaacttggaaagccacgctacttggcaaaaatttggccaagacgagccgtcatataacgtgccagggtcgcttccccagtggaaagaggccgttgtcgaccgggcccgcagtaactacgaaacctttaagaaccacaccgccatcctcttctggtcggtggggaacgaatcctatgccggtgaagacattttagccatgaataactactacaaagaagttgatgatacccggccagttcactacgaaggggtcgtgcacaccaaggaataccgtgaccaaatttccgactttgaaagctggatgtacctaccgccaaaggaagttgaagcctacctgaaaaagaacccggacaaaccatttatcgagtgtgagtacatgcactcgatggggaactccgttgggggaatgggttcatacatcaaactcttggataagtacccgcagtactgtgggggctttatttgggacttcgttgaccaagccattgaagtggtcgacccagtaaccgggcaaaagtcgatgcgctacgggggcgactttgatgaccaccacgctgacaatgaattctcaggtgacgggatttgctttgctgaccggaccccgaagccggccatgcaggaggtgaaatactactatggattacacaaataagctgcacgtcgtttacgacgacaacatcttaggactggacggcaaggactttcagtacctcttctcctatgaacaaggggggccggaatcctttaagattaagggtaaggagtggctttaccggagcccgcgccccactttttggcgggcaacgaccgataacgaccgcgggaacggcttcaacgtctcgtcggttcaatggttagcggccgactatgttttgccgtgccaagacatcgccttacaagtcgacggtaaggataagaagctaccgctagcaccaaaaaccaaccgctattctaaccaagaatttgccaagaaggttaaaatcacctttacctaccagacccagacggtaccggcgacgacggtccaagtttcctacacggtcaaggctagtggtaagatcaaggtcaacgttcactacaccggggcccagttaccaagcctgccggtattgggttggcggatgatcatgccgacgccggccactagctttgattacgaagggctatccggggaaacctacccggaccggatggccggggggatcgagggaacctaccacgtggaagggttgccggtgaccccatacttggttccgcaagaaaacgggatgcacatggccaataagtgggttcaaattacccgcgccaccaccttgaacaacgccgacccggatgcggcaccgttccgcttgaagtttgaggcccctaagaagggaaagttaaacttctcgtgcttgccgtacaccagcgcggaattagaaaacgccacccacccagaggaattaccagctgcccaccggacggtactggtgattgccggtgaagtgcggggggtcggggggattgactcctggggcgccgacgtggaagaaaagtaccacattgacgccacggtggatcacgacttctcctttaagatcgtgcccgagcttaactaaattcaataacggagcccgtcgtttactaagaaaagcggcggggctttttattgttttaatcggattttaatatttgatcagcagtggccgggatttgggtgtaaaatttaaggcatgttgataaaggagcgttaattaaccatgctgacaatcttttgggaaagcctgtccggggtgttggtgatcttgatcatggtggtgtgcggatttgtgatgaacgaacgccactggtttagcccccaatccccgcaaatcatctctaaggtggtaacccaggtcgccttgccgacctacatgatcgccaccattaccaagcagtttacgaccgaccagttaaaaaccctcttgccggacctccgttacccggtgatttcaatgctgatcctttttgccctctcctttgccgttgcccgtgccttggccatccaaaagagccacctcggccttttttcgtcgatgtttttcaactccaacaccgtcttcattggcctaccaattaacatggctctcttcggggcgccctcggttccttacgtgctggtttactacatggccaacacgaccttcttttggacgcttggggtgtggttgattcagcgcgacggggtgcacgaagccaaaatcaacgttaaacaggccgtgcaaaagattttctcgccgcccttactaggcttcattggtggggttttgctggtggtctttaagattcacttacccaagtttatcagccaaacctgtacctacttggggagcttgacgatccctttgtcgatgctcttcattgggattgcggtttccaacgcgggactctcccgcatccgctttgaccacgacgcctgggggattttactagggcgctttttgtttgccccgtgcttgatggccctgctggtcttgccgagccactcgatgtcaccgttaatgaagcaggtctttatcttacaagcggcgatgccggtgatgaccaacgctccggtcgtttcgcgactgtaccatgccgactcgtcttacgccgccattatggtgacggaaacgacggtcctgtcgattatcgtgatcccaattttgatggtgctgatcaaaacttttgtctactagtgttacggtgagtgggaaagattaagggaggctggaaaagcggggggtaacagcctccccttgcagttacgaaggttagactggaaacggggccaataaccgcgggtctaatacctaagtaggccgaagaacgccgcgttccgcatcaaccgttcgtccgttcttacatacgacctactccggaagttgctcactttcgtaatgattaaccagtatttcccgggaaattagcaagaaattggggggcgtttgcgttatcatggatagggtaagagagggggaaataggatgacaaaactggtgatggtgcgtcatgggcagagtcaggccaacctagacaatcgtttcacggggtggagcgatgtaccactgacggccaaagggattgcccagggtaaggaggtgggggcggaactagccgcccgcgagttcacctttaccgacgttcacacgtcctacatgaagcgggcgatcatgaccgccgattacattttggaggccctggatcagttatacctgccgatccacaaaacgtggcggctgaatgaacgccattacggcgccctaagtggcctcaacaaggaggcggttaaacgagaagttggcgaacagcagttacacgcttggcgccggggcttctttgccgtcccgccccaacttgctcaccccgctcacgaccggcgctacgatcggttaggggtaaaagagccaccggccgaaagcctggaaatgtgcctagagcggatccttccctactggcaagaccaggtggcgccccgcctccttgccggccacgatcagttaatcgtggcccacgggagtaccctgcgcgctttggtcaagtacattgaggggatcagcgatgaccaaattgaccaggtggaggtcttaaacgggcaaccgattatttaccaatttgacgaccacctcgtccccgtacacaaggaaattttaatggaggaataactaatggcgattcacgagttaaacaataaccccaccttagccggtcaggtccgcttaattgaaaacgtagtctatggcgcggcggatggtgaggcccagcaaatgtctttgttgaccccctgggcccagcgttatcaggccgcacagttacccgcccgaccattaatcgtttttgtccaggggagctcttggtgcctaccaaccctgggggaagaaattccccaactggtccagtttgttcaccagggctacgtggtggcgacggttcaacaccggaattcacttgatggccacgcctttccggcctttttgaccgacgttaaggccgccattcgttacctccgggcccacgcaacggaatatgccatcgacccggcgcgtgtgtcggtctgggggacgtcttcgggagccaacgccgccatgttggtggggttgaccggtgacgatcctaaatacaaaacggctgccgatgccgaccagtcggatgcggttaacgcagtggtagcctgcttcggtcctaccgatgtggtggcgacctttgaacatagccaaaccgtccccggtagcgatgtcttgcagtattccctgtttggcaccgatcggactaagtgggaccaactcaagcgggaaatgagccccctttaccaaatcaaggagggaaaatcctacccaccgtttctgctcttacacggggatgccgatcaaatcgtgccctaccaacaaatggagcaaatgtatgacgccctgttagcccaccacgttcaagtcgacggggtacgggtacacggtgctaaccacgaacgggatttttggagtcaagcgatctacgattacgtagcgaacttcttgaagccaattaaccaaccggtggccgattaaagacgtttgaccacgctttttaacattgattataaaaataaaagaggccgggaaaaacggagttttacccggcctcttgctatatatccgaaggctagacagaaaacgtggtcaataaaccgtaggccgtatgcctaagtacggccgaagaacggtgcgtttcgcatcaaccgttcgtccgagcttacatgcgacctgccgaggagattatttcccactctcatagtccctgaggccatggacgaccttagctccatctgttagggtaacaaaaaagttcagaacgagtaattttcgtcctgaactaatcttaggtttaggccaaagttcccattgggtcccacggctttaaaacgactggttcctttgcttgggcggctaagaggtcgtcgctcaagtaagccttgttgatgaccacttggtagcagtacttatccatccaagcgtcggacatgacaaagtagcccttttcgccgaccttgcttccccaggagttttcaaccttccacttggttggctggccgtcaacgatgtcgaccccggtcaaaaccatggcgtggttcatcattgattcgccatagtctaaggagtcggcctttgacatggctagttcggtgtcgaagaggtcttcgtaggcgtaagtgtttaaagccatcaagcctagcttggtttcggaatacttagaaacgtcggagccgaaccaaacgctctcaccgttttcgagttgcttaaccgccaaggccttaaattcatccattggtaggtttaagtgcttgattggccggcccccgaccacgttacccaacatgtcaatcgtgtaggtttggtggtaggacttgtctttagtcggggcctgaatgatggaaacgtagtcgtccaagttccagccaacgtacttttggaagaattcggtcggcgttaagttagcgtcacggtggaactcgtggtcctttttggtccggtactcaaaatcaaaggtagttactggttcgccaaaggcatatgacagcatccggtagacgttgttgagcatcgaccggcgctcttcgtcgatccgggtgggggcgtagttttgttggaccagttgccgtaaaataacggcgtcgtggcgcagctggttatttaaaacggcgttaatttcgcgtgattgagaggagttgtagctttccggcattgcgctttgcggaacgaccccgtacttttcgatcagggcacacaacatgtcccactgacccccgtcttgttgcggggtttccatcagccaagccaccttccgatcatcgtgaggaaggttggcggtctggatgacgttttcgtagaagtagttggccttttcgaacttgtcccagaagaattggtaggattgggaaagctcaaagtcttcgggcaggttgaacttttgttgcatgtcgtggcgcatcgtgtttaaggccgcaaacatccagcagcgtccggattgcttttggtcggcaacgttaccggtggaaaggtcaatcgaaaagtgttggtcgttgtcggccttggagtgccaatcaaagctagcggccttgaccccgttcttggtgacggctcgctctaaaacggcgctgtccttacgaccggcatagtcttcgtgaaaggccgctaagtcggcggcagaaattgaaaaactcatctaaaaatacgctcctttgttgatttaggacccattataatacgaaatcgggcggcggggtggttagtagggaaagttctctaagcgatcggcggccaagattatccggacaacccggccggggacaccaaccaccagggcgtctttaggaacgtccttggtgaccacgctaccggcgccaatcacggcgccgtcaccaattgtgaccccgcccaagacggttacgttggcccccagccagcagttgttaccgattgtgatcggggcgcccagttcgtagtcgaatagttcgccgtcttcattaacccgggcgttacgttgctggtagcgtaaggggtgactagccgtggtcagggtaacgttgggcccgaacatcacgttatcgccgatcgtcaccgggcaggtgtctaaaacggttaagttgaagttggcgtaaaaattgtcaccaatcgtagtgaagcgcccatagtcgaactggatgggtccttgcaaacaacagttgtgaccgtgctggggtaccaactgttggagcagggacgcccgttttccggtctcggtttctagggtttggttgtaggcggcacacagccggtgtccctcggtgcgaaaggcggttagttccgcactttgcggggtgtagggaaggccttgtagcatgttgttagtgttttcttccattgtaaccatcctttcgaaatgaagggcttagggagcggtgagggtggtaatcccggcctcattaccgacgatcacttggttgacccggtttaagaagagaccgtgttcaaccaccccaaccgtgttaatgagatcttcagccagggccagcgggtcggttaacggccccagtttgaggtcgatgatgtagttgttttcatcagtccggtataattgacccgcttcgtccgttcgccattgtggctggtaaccctgatgctcaaacttcgcaaagaccttgcttgcaccaaacgggatcacttccaccgggaccccgaaggcgccaatccggtcaaccaccttggattggtcaacaatccacacgttattggttgaggcgtcgttgacgatcttttcccacaagagggcacccccgccccccttgataccataaaagtcccggtcgacttcatcggcgccgtcaatcgtcaggtcaacgtggtcgacgtcatcgaggtcaacgattttgatccccagggaagtggcctgggcagtcgtccggttggaggtggtgaccccagtaattgctaggccctcttctaggacccgtttgcctagggcgtcaactaaaaaacgaacggtggagccggtgcccagcccaacgatcatgccgtttttaacgagcttggtggcagtttggccaaccaattggagtgtaaattaatggttgttacctaatctaggtcgacgggcaccacccagccaaacttgtcttcgacgtcgccgttttggacgccggttaagtagttatacagcttggtcgtcaccggaccggtttcggtttcggagtaaaagacctgctttttccccttataggttagggaacccaccggggagatgacggcggccgtccccattgcgccggcttcggccaggtcgtctaagtggtcgacttccagttgcttttcgaccgggttaagccccagttctgcagctacttgtagcaacgagcgcttggtgaccgatggcaggattgactccgatttaggcgttacgaactggccgtccttagtgaccccaaagaagttggcaccggagaattcgtcaacgtacttgtgctcgcgcgggtctaggaagaggcagtcggcaaagccggccttcttggcttccatttccggcaggagggagccggcgtagttaccggccgtcttagcttgcccggtcccggcgtaagcggcccggtcgtacttggaaaccgtgaatggtaccgggtttagtcccttgacgtaggcgccaaccggggtggcgtaaacgcggaaggtataggtgttggacggtaccacaccgaccaccggctgggtgccgaccatgaaggggcgcaggtaaagggtgccgccggaaccgtacggcgggacaaattcctggttggccttgacgacggccttgaccgcttctaagaacttctcttccgggtagggttccatcatcatccgcttggccgagttaaccatccgcttggcgttttggtcggggcggaaaaggttgacctggccgtccttggtccggtaagccttgaggccctcaaagacctcctggccgtagtggaggacctcggcggcttcgttcagggttaaagttgattcggtcgtcaggtggccaccttgccactggccgtccttgaattcctccgtccagctgtaggggaggtcgtggtattcaaagccaaggttgttccagtctaagtcttctacgcgggtctttgtcatggtaattcctccttaaagtgggtgacgcctacgccggacgccgtatgaattatgcagtgtgcattgcaatggcaatatgtgtaattggttggcgtaaatatgtgtagtgatgggtaccaatgttttgaatatgaatctctgaaatgtctgccttaaagtgggtgacgcctacgccggacgccgtatgaattatgcggtgtgcattgcaatggcaatatgtgtaattggttggcgtaaatatgtgtagtgatgggtaccaatgttttgaatatgaatctctgaaatgtctgcttccacaactcatcacctttccttcgttagtttggttgaacaaaaaaacgccctactagcattgctaataggacgacttgcaccgtggtaccacctaagttcgcttgaaaaatcaagcctcaaacgtacgatcgctcatacgctgcacgataacgggtgccaccttgctcccttaccaatcggggagcccgctcaagaatgatcttcagcagtcaggcgccttcccgtttcaccgttaccgggcttctcttagcgcaccagtcatgcttactgtttctctcatcgcgttgtttcgttcaactgattggtacccatcttaaagccgggctctcacgatgtcaacactttttctcatcttttgttaatttatttttaatctagctgggtgatcagcttccgtaaggggttctggttatttgggcccgttaactagacattatttactataacttaacgtcataaataacaaccaccaaaaaacgagccctagttacagggttcgttggtgaagctaatcaaagtatgacggagcaatctttcggccctggtggtaatatactgacggtcgtgttcgttaatctcgcggatgaccttggccggcaagccatacgcgaccacgttaaccggtaggtccttggtcaccaccgagccagctccaacgacggtgttatcaccaatcgtgacgcccggtaggacaattaaccggcgccgatccgacagttggttccgatgtggatcggcaggttgtattgcatttccttggcccgcagttctggagccaccgggtgggttccggtggctaaaatgacgttggggccaaacatggtccggtcgccaacgtaaacggcggtatcgtcgaccatcgtcaggttgtaattagcgtaaatgtagtcgccaaagtgggcaaacttagccccgaagttggcgtgcaggggtggctcgatgtaggtgtgttcaccaatttcggcaaacatcttttgcaagagctcctggcgttttttcccttcggacgggcgggtttggttgaagtcgtactggagttcttgagcggccaattgggccttagcgatatccggatcgcttggtaagtagaggtccccactgtgttgaagatcttgggctttcataacaaaatcctttcggttaattttgttcattatactggatggtaacgaaactatgcaagcgccttcacgggttggtataatgagcaaaagaaattaaatttggagggtgaattatgagtgaagaagtcaagattgatgccaaacgggtacaagccattaccaacatgggccaagcttacgatgacgtcgatcccctggtggaagccgcccgtaaccacgcaattaaagagtgccgccgttacaatttcttggtcaactcccaaaacaagtacgattattcgatcctgaagggcctcttcaacaagatgggggaggaaaattacatcgaacccaacttcatgtacgaattaggcctgaacatttcgctggggagcaatgtttacattaaccacgacatggtgattttagattgcaacgaggtcacgatcggagaccacgtttacatcggccccaaggtcgggctgtactgtgccaaccacgccgaagacccggtgggacgggcgaaccaccaagtgtacgtcaagcccatccacataagcgatagcgtcttgcccggggtgacgatcggcgagaactcgattatcggcgccggcagtgtcgtcaccaaggacatccccgctaacgtaattgcggccggcaacccctgccgggtcatccgcgggattcagaaaaaaggctaacaccttaaacgaactcagtttgaatgcctagctaatcgaataaagcctctctccgaacttcatcggggaggggctttttagtgcggttaaagatcttgatcatccggcaagtttttcaaatagcgttggcggaattcttggttgccaccccagaaaggtttaacacgcctggtcgagagcttcttgatactttcgagtcggtcgcgttctgcttgccagacctgctcttgctcaacggtaccgggggttaggctaaccatctcgtcaaggagccggtcttgttgcgtagcatcatctgttaaataataacgcattagtaacccaataaacttagtattgctctctggctggagcggtaaaactaagaagtcctgtgtttcaaacgctcccatcgcctcgttagccgcaattaaggcggtcctcttgttaccatcctggaatggttgcattttagctaaatcggcgaaaactcgccaaccatctttggttgtgtattcagaggtgtcgaaacggtcgatcatttcttggagaatcccctcagtaacaatttcgggcagggtgtaggagtcgcctattaggagagtaggaacgttccgcaatcatgtggacattgtcctcttcgttatacatgtaattccgcaaatggccaggaagcgtgggggcttcgatgggactattggtgaactgttgattgattgcaatgattccttggacggtaaaaccagtgctgataattgcattaacgccgttttggatatccttaaataaatcttggtctgtcctttaaatacgaaagatccttcgttgataatgcagatttagtactagttaaggtgctaccgtaattatttagcgaaccagttgacgcaatgaaaaaggaaaatttattgatgtcaatcttcatggggcacgctcccgaaaaaatagtaatacgaagccgttgctttaaattatatcatcaacggtcgtcgcagttagttatctgcctgtttaaagtgcttcaccctttttattaaagaggggaaggggctttaagtaggtgatgtctgtccggttgacggcgtctccttcggcaaggatggcagcctgagtaataacggttgccccgcactcctttaacagctgagcgccggcttttaaagaaccaccggttgaaatcacgtcatcgactaggattacccgttgcccctttaaagcatgcgcatccgccccgtctaagaccaattgctgcggttcactagtggtgatggcttgaacggtggtcacgtaggggttgtgcatgtaagccttaacgcccttgcggatcacgaagtagcggggatgcttggttaaaagggctagttcatgggccagggggattcccttgctctccattgtcacgagcgcgtcaaaatcggtgggcaagaggggggctaacaagcgggcagcttcgtgggtcaattcggcgtcacccaggatgacaaaggaggcaattttgagctcagaattgaggtcaattaagggtaattggcgctgcaatttgccaatttggagggggtaatttaacatttttctcacctttttgataatcttaactttcaaccaacatcttaccattattgttcgttaattgatagggagaagggggtgggagaaggttatgaattataataaggttcgtcccgtcacgattaactagtcttaataaaaacttaatgaaagcgattgaaaagagtcaaaaaagagcgaaatgttttaaaataaaccaaaaatacggtaaattaatattaatcgatttcgtgattttcccgtttttcctggatgaaaaactggttaaccgtcagcaaggaagttaccgaaatccggataatgacttcaaaattaatcataattttcgaaggaggggatgctcttgaagtcagcagactaccgcaacgccccaatggagaaaatgagttggaatgttttcattggtgttgtcttaggacaaattgttagtagctataccttagggatcgtcggggtcgccctcgaccgggtgcccagctccatgaccctatccagtacttggttagggctcttgggggccgggtcattaatcgggctgtttggtagcctcttggtggggcgccttgccgaccgctatgggcgccggaagtttttcatggccgatatgctcgccctaacgcttctatcagtgctacaactattcaccactaacttagccgccctgttagtgattcgaatcgcccttgggatggcaattgccgttgaatacacggtcggcaccgccctattgatggagtgggtgcccgccaaaagttactttcgttaccaaacctacctgttagcatactgggcgattggttactttgccgcctacctagtcgggacctttaccaccgggtttggcgaccggacttggcaagtgatcttagcctcgtcggcaatcgtcagcactttggccgggctacagcgcctcgtggttcgtcaacccgagtcaccacgctggttggcctctaaggggcggattatcgaagcaattaacctggtgcaccgttacgtcggcgaagattacacggtccatccggccccgcaagtcgaagtaaaaaagggcgcctggcggatgctgtttagcaaaaaataccggcgccggaccttggtcggcgggctcttttacgcttgccagaccttcccgttctttgggatcagcatcttcttgcccatcctgatggaaaatatgaacgtgactaaccccttggtcacccagttgctttactacgccttgatgatcgccggggtcctcgtggggatcgtcttgagtaaccgcttgccgcgccgttacttcttgattgggaccttcttagcctcggcggacttcctgctggtgctcagtatttggcaccaggccccgttagccttaacgctaatcttgtttagcctcttttccttgacgatttcggccgccttggtaatggactacgcttacccaaacgaactctttgacgccagcatccggacctccggggttggaatgtgcattgccattagtcggattggggccgtggccgggaccttcatgttgccaatcatcagcaacgcctggggcagccaagcgatcttcatcatctgcgggacggtcttgttaatcggggggattatctgttaccaatgggcaccagaaacttccttgcgctttgccaagcacaaccgcagcaccattaacgaaccaagcggctcccgggtaactagtagtcgctactcggacagcacgattgattaaagcacggttgacaccggttacaaaattagttattcttaacccatcaaattaaaaccactttttccgacaccggttgggaaaagctaggcacctatgattagccgtaggtatgacggattccgtctaaggctgatcatgggtgccttttttcataaaaggaggatttaacatgacccaagtaacgatgttaagcgcaagccagattagccacctcttggacatgccagccgtgattgacgccgtggcggatacttataaggaaaaggcgaatcatcccgcaacgctttggccaatggtttatgagcaactcggaggtgaagcggacatggacatccgttccggggtgttagcttctaagcacgttttcggcaacaaactcctcgcttggttcggcgagaatgccaagcggggtctgccagaattaaacggcctagtcaacctttacaacagtgataccggggagccagtcgccgttttaaacgccaccgccttgactggttttcggaccggggcggcgggggccgtcgctagccgcctcttggctaacccggatgccacgaccttgttagtggttggcacggggagccaagccccctaccaaatcatggcgcagctgtgcgttttacccaaggtgacgcaagtgctcctggctaatccacgcgacgcaaagaaggcccaggcggccgcagcccaaatgccaatgactttagagaaattgtttagccaaactattagggcgaccaattcggcgaccaattcagtggttgcaggcctaattaaccaccggctaagcgaagttgaatttactggggtcactgacttaccagcggccgtacaacgctctcgggtaatcgtcaccgccaccccgtcgactaagccgctgattcaagccgacggggtgcaaccggggacccacctcaacgcaatcggcgcggatatggaaggcaagcaagaactcgaagcaaaactatttcaaggggcccaggcctatactgatgacgtaccccaggcaagcgaggttggcgaaatccaaaatccaattaaggcaggcgttatcaaaccagagcaagtagttgaaatcggcaactccctgctggatccgaccctagggcgtcacgatgcgaatgccatcaccatctttgacagcaccggaattgccttgcaagacttagccgccgctaatttagccttcgtgcgggccaaagaacagggcatcggtactcaagtagacctataaggaggagtaccatgaagattaaagactttggcgtggaacaatggatgaacgaatacgaaacgaaggctaagtataacctgggcgaaacctgcgtttcctcgttaagcatccgtgaattgtgtgaactggtgggtgtggacgttaatgactttgctaagcagctggttgatcggcgcctgacttatggcgccattgaaggggcggtcgagctaaaggaagcaattacccggctctaccagaatttgacgccggacgagatcgtgaccgaacacggggcgattggggcgaacaacttggtcttaaacgccctggtggaacccggggatgaggtaatcgccgtgacgccgacttaccagcaactccagtccatccccgaagcaatcggggcgacggttaagttactaccgttaaagagggaaaacggctacctcccggatgctgaacaattgcgggggttagtgagtgacaagactaaactaatcgtcttgaataacccggataaccccaccggcgccctgatgagccaagcagggctccagacgattgtggacatcgccaagagcgttgacgcttatgtattgtgtgatgaagtctaccggcacctgacccaagaagacgggtactcaccgtcaattatcgacctctacgataaggggatttcgacctcgtcgttttccaaggtcttttccctcgccgggattcgcttaggttggttagcgacccacgaccaagcggtgatgaaggcctgcctgtcctaccgcgactacgaaacgatttcttgtggccagttagacgaaatggtcggtaccctagccctgaaaaaccaagcagtgctcctggagcggaaccgggggattgtccgggagaacttaaaggtcttagaggaatgggttcaccaacaaccacacatcacctggttaaagcctaaggcggggaccacggcgcttttgtactatgactttgacctaccaagcaccatcttttgtgaccgcctaatgaaagagtacgaaaccctactggtaccggggagctgctttgacattgagaattcgctgcggatcggctacgcctttgaaaccgcccacctgcgcgatgggatgaatcaattggggaagttccttgctaaattagaacaggaagcaaggtaaggatgcacccctttaattatgaaaaccgcctagtcactccgttgtaagtgcctagacggtttaccaaaaattgtaattaattacgttgacaaagtaaaacaagagagtactctaataacataagctacttaatgctagcttacacggcgacaactccacgaataacacaagcgattgtggacaaagggaagtggtcaaaatgtatgaagcattgttgcatgtagcaaccttgtttagcctgatgagcggcggcgttcttgcggtggtatcaacgattgataagttgtacgacctaaaagaaaaagcccacaagcgaccgggcgatcacaaggggcaataagtaagtagcttatgagttaaaggctgggtgttgcaccacctagccttttgctacagttactttatcacgaaagggaacgggtggcaaacgatgagatggattattttaattgctttgtttgcattggacgttggtatcgtatggttaatcgttcgcaaggttaagtccattcttgctaagagaaaagggcggcgttcataatgccaagacctaagacgttatctgataagcaacgagaagaccacgctaaaaagagtcgtgatcgttggaatgctgccaaccgtgataagggctatcgctaccaaaagaaatcacgtgctaaaagctttatcaaaaaagacgcatcgcttgaagaacttcaggagctccgaagtttgattgatgatcggattacagaaatgagggactagtcattatattggctagtctttttttactacttaaatggtccttgcaaacctggaccgacctcaaaaacaacgttaatgagtcgctggtgagccgtaataatggtcagtcagccgtgaccaaagcctaccggcagatcttaacggagtcgaccaccgctactgtcaccggtttgatgacccacgaggacgccgtccaggcagccatgtaccgggtggttgataaaggactgccgaccacgttgatcgataaggcggggcgcaactggagcattgaaggttacacacggatggtggtcaacacgaccgtcaaccgggcatttaacgaggttcgcctgcaacggatgaaagacttcgacatgcacttagccttgatgtcgtcacatcccaacagccggtcagcgtgtgcaccaattcagggccacgtggttaacttagtttcgccgagtgatccggactttgacccacactacgattcaatcttcaatcacggatatggcgaaccgtctggaacacaagggattaactgccggcacattctgttcccgtacgagccaggcgtcagtgagaaccatcaaccacagtatgatcccgatgaagcgatcaaaaacggcaagctggtccaacagcaacgggcacgagaacgggccatcagggacgctaaaaagcgcctgagagttgcggaacaactcggtgatgatcagatggtgagccagactaaaacgctcctacgagcccgccaggcgaaactacgggacttcatcaaagagaccaacgccggcaagaagaatccgattctggtaagggattattctagggagaagatcgtcacaaagataccgataatcaaggtgaacgaatcggagctgatttcaaagaccgttcaacattacgggtcctttctctagtgtagagaaggtccatgcctatctttccatcctttcattggcatcactcctctcaaatacggagcgtcgccaaaacgaatacacccaactggtagtggcggggtggaggaaagcgagctcgctgctaaaactggcaatgggctttttaaatggggtagtgttttggcttaaattaacctgtcattaaaattatagttttaatgacacacattaaaagaaaccctttagtatcaatggatttcgtaattttattttcgttgtttttttacacaccttggtttaactttgcaacgccccgctcgccttcgctgttggcaacggttggatacttccccgttggttgaagaagtttaaccaggatgccaaccatcaaaaccttggaacgaaccaagactgggcgccggacggttaattagtgccacttttataaatatatgaaaaaaccgtccagtgtttggacggctcggatggcttaatttaaatgcttcttgaggaactccaaaatgagcttgaagacggctggttgcatgaactggacgtccatgtggccggcagtttctaattcatagagatccgcatcaacgcccgcttggttaagggcttcgtacaggacctcggagtctttaaccgggacgacctggtcctgttggccgtgcaggattaagaatggcacgctcttttttgaaacgtaggtcaatggattggccttggcatccagttccggggcgtcctctggctcggcccccagtaagttacggtaaacgaagtcaaaggcgtctgtggcgctgccttgtttagcagttaacgggtcaaccacgccgtaccaagggactgccacttgaacgtcactggagacgtctaagtggtcgccgacgtcaaattccgtcatcccgttggtcaaccccaacatggaggccaagtgaccgccggccgattcacccatcacgacaaagcgatcgggatcggcctggaacttcgcggcattagcgcgcatgtaacggatcgccgccttggcatcctcgagttgacccgggaagttgaccttgttagaatcgcggtactccacgcccacaaccaaataccccgcccgggcaaagtcaactaagtttggcaagtggatgttgtggtcggtatccatccatcccccaccggcaaaccaaaagatcactgggaacttggtgtcatccccggtggcaaaatggcgtattaccgacagccgtaagttgcgggtggcgttgcccagccagccgggtacctgggcatacacaatgtcggaatcgagccaaagcccatcccgttcaacagcaacgttaatcactttcttcaaaagaaaaacacctccaatgctctcatgatagcgcattcgggaggcgttttaaagttatagcttcagttcgtataagttggcttcttgacgaccaacgtcttcgtagtcgatgacgacccgtttggcgagttggtagccgttcttttggtataaggcatccgccggtgggttaccgtcaattacgtctaggtgaatgacgatgacacccgcctctttagcaacctgcttgagttgtgctaggagaccactagcgacccccttgccacgagcggcggggccaaccgccagtaagtgtaggatagcaatttggtcgtccgtggctgggatcttccaggcctcgctcgggtaatctgggtcttcgcccttcgtcaggatcccggcccccagtagcgtaccatcgtcatcaaaggcgccgatgaacaagtcgttgaggctttcttctagcgactgttcacttgggtaaacgccccaggtccaatccggactgtattgatcgaactgttggtggtcacaagcatccttataaaaagcgattacttgcggcaagtctgttttagttaaacggcggtaattaatcatataattcctccttgcgccatggcgtttggtaagggaaccagtggttggcgctgtggtcccctaaccgtgagaagggaaccatttcaatcccctgctcctttaatttgtcttctaagtaatcacggacctcccaaacgtcgctagggtctgggtgctctccatgtttaacaccgcgtccagtcgctcagcgttcatctctaggtcggcgagtacggttgcttctggttggtttaagcgtcggtaattggcctgtagctcctctttagtcgccttaatttcggcccttgttaacatcgcaacgcccccttttcagttatactgatattataacaaaggaggtcggatgaatggtgacgttattaatcggggctggattaatcatcctggggatagtggtgattgcccacgatcgccgcacccttttaagtggcctcttgcccttcttagggttactaacctggctcactgggctgacccccgtttggctggctagtaccctgtttgtcatcattctcccgctcggcattttaggtgaggtgttgacccacgatggctactggctactgagccgttacggtacgtctgctaagggctacttctttttggtgggtggttttttggtaatggtgttcgccccgctgttcctagttttatggctactatggcgctcagttttgaccgttaaattgatgttggccatctacggctacgtggcggtcctgattgacgcttaccttttggcaacggtgatcaacgccctgccattaacaattaaaccaaccaagatactaattttgggcgccggtctcatcaaagggggcgtgggtccggttttacggcgccgcttgctaggcggcttggcgctttaccaacgcttccccaaggctgaactgattatgtccggtggtcagggggacgacgaacccgaacccgaggcggtcgcgatgcaccggtttgcccgccaaaagggggttcccaagtctgccatccgcttggaaaccaactctaccaatacagcaaccaatttgagcgaggccaagcgcttcattaactcaggtgaccgggtggtcttggtaaccagtgattaccacctcctacgctccctgctctacgctcgccgccagggggtgaattgtcagggcctggccgtccacaccccccacttcacctttacttgcaacgccttcatccgcgagttgggggcctacacgatcattcaccggtacctcatccccttagggttagtgttggtgattatactttgtctaatctaaaaaccgggtgtccagtggaccccgatttttaaattaatcacggtcatcgatgtagtcgtcaaccccgtttggattccccgaccacttgaatttgtcgtaccaaatggcgtgttcttcggtgttgagactgaaaatggtggccatttcagtgtcggttaaggtgaagtcaaagacccgttggttagcaatgattcgttcttcgtgaactgacttgggaataaccacgagcccctgctggagttcccaacgtaaaatgacctgggctaccgtcttttgatgggcgtcggcaatcgtttggatagttgggtttgacagcgcagcgcccccacctagtggtgaccaggcttccacttggatgttgtgttggcggcataggtcgcgaacgtcatcctggtggatccgggggttaaattcaatctggttgaccgccggaacgacgctcccgttatccaaaaggtcactgagccgttcaacgttgaagttgcagacaccgatcgccttcgccttgccggcggcgtaaatttcttccatcgcccaccaagttgcgttgtatagcccgttaactggccagtgcatcaaaagtaggtcgacgtaatcggtttgcaaggcgtctaattgcccttcaatcgcgtctaaagttggttggtgaccctggtcaccgttaaagaccttggtggtaatgaagaggtcttctctggacttgccggtcgcctttaagccttcctgaatcccctcgccgacgccggcttcgttgccgtattgcttagccgtatcaattagggtgtagccatctttaattgccatggtaacggcttgcttggcatctcgattggaggtcttccaaacccccatccctagctggggcatcttcagtccgttatttaatgtcactgttggaattgtcataatatcccctcccgttaaagtacctttattatacgccaattgaaagcggaaacaaaaaagaggccataaatgacctcccgtgagtttttgacttaattcaagcgcacggcccggtttaaggcggggatcagtactaaggcaacgacaacgcccaccaccccttgcaagatgttagtcccgatcccgagtaccccggcggtgatcgtgtagagaactgtgtcggctacgaagtaaccaatcaccattacaaccaccccaacgcttagggcgaggtagcggttatgggttcgctggtaaaggtagccgataacccagccttccagcccgtgggcgattaaagaaaagggcgcgtaagcaacgtaaccagagatcaggtctagaatcatcccgctcaagccaccgaccaccccaccggctagcggcccaatcatcagggcggcaatcataatccctaggtcacataggttaacgttgccgtgggtccatggaatcggaattaaaaagaagcgtcccatgacgacggctaccgccaccaagagggccgttaaaacttgcttttgtgtgcgttgatgattcatcccaatcaatcccttctatgcttcaaaactggtcaagtaggccagtaagtgactaagttgcaagccgtagcggcgttggccctcgtcaaacggggccgtttgaacgatcgctaggcgcaggccttcgtgggcaacttgaatcgcccgctcaaacgggacgtccttgaccagttggctggctaaaatggcgctaaacaggtcgccggtgccgtaaaagtggcctgggatccggggcgccatcaaccagttaaactgatcgtccttttccgcctggtaggcagttgatgaagtcccctgccctaagataccggttacgatcacccgagcggagatcccctcttggcgcagctgctccaccatggtatctaatagctcctgagtgcactcactggtggggtcataaccggctaagaggcataactcggtccagtttggtgtgatgacggtcgccttttggcaaagctggcgcaccgccactacgtaatcttcatccagaccggggtaaaggctcccccggtctcccatgaccgggtcaataaccgtgaccggcaaggaaaagtggtcaatgatgaccgaaagcttatcaattaaggcggtttgaccaacgtagccaatcaggatgccggcaaactcctcccccatgtcaagccactgggcaagggcattttccagccattcctcagttgacagggctactggggtgccaaaaccttccgactgggttgaaagaagggcggtgggcaacattgctggtcttacggattgggcttgtaccacaccgagggcattggctagagaaatttgccccaaggcggtcaggtcttcagcaatcatcagtgttttcattgtactcgctccctttttgaacacatctcgtttgtacgttgattatagcacgcctcgatcattaaaaaagtctaatgcaaaaaaagaaagggcttttcgggaaataaaaaggccccgttaaccactttttgatggtgttggggctccttttggtcgcttataggtggctgacgaggtaatttccgaacgaactggtcgagaggacgttggcagccgttgaggttgctaggtcggccgtcacgtgttgcgatgcgatggcctgggcgatcccctggcgaatcaaatcaccaactgcttcccacccgaggtaatcaaacatcatcgccccggacagaagcagggaggtcggattcatcttgttttgaccagcgaattggggtgccgtcccgtgggtggcttcaaacaacgcttggccggtttggtagttaatattagcacccggcgcaattcctatcccccccacttgggcggctaaggcgtcggaaaggtagtcaccgtttaggttcaacgtggcaatgacggcaaagttttccgggtggaggaggctttgttgcaagaagttatcgcaaatgacgtcgttgacgatcagcttcttttgggcacgggcgtcttgaagggcctggtcagcctgatgttgactagttttagcaagggcctggtattgtgccattgtaaaaagtcggtcaccgtactcttctgctacttgatagccccagtttttaaaggccccctcggtttgcttcatgatgttacccttgtggaccagggtcagggtgagttcattatttctcaaggcgtattcaatagcggcccggactaagcgggtagtcccctcctttgagaccggcttgatgctgtaggcagacgtcgccgggaagcgaaccttggccagttgccgctgttcttttagcagtgccgttagtcccttggccgcctctgtccccacccccatctcgattcctgcgtaaatgtcttcggtgttttcgcgaaacagggtcatcttaacccgttcgggataacggactggcgagggggagccgggataatagcgaaccgggcgaacgcaagcgtataaatcaagttcctgacgtagggtgacgttaattgaacggtgacctccgcctactggggtggtcagtggccccttgatggcgaccaggtagcgtttgagggcggcaagggtcgcgtccggtagccagttcccggtttgttcaaaggcggcttgacccgctaagaccggctgccaagtaattcgtcgcgttcccccatagacctttttaacggcagcgtcaaagaccggttgggctgctgcccagatttccggcccgataccatcccccttgataaagggaatggtggggtaatctggaacccggagttgaccgttttcaagtttaattatttctcccatgttttcctcctaactaagtgctaaaacaaaggcggtcaaggtaatgaaggagagggccgtgctccaaaactgggtcgaagctaactcggcttcgtggacattaaagcgaattgccagcgtggagggcatcgtggccgtggggatggccaaggctacgaccaccaaccgggtcaggggcgtcggactattgaaaagggccatgcatccccaaacaactagcgggaaggcgaggttcttcaataaaatagtagaacaaatcgttttgttgaaagtgatctggcgggtctttaatacgatcccggtggtgaaaatggctaacccacctgcgcccttccctagcagggtgaaaatggagtcaaattgcgtgggcatttgggaaccacataaaactaggataaagcccagcaaggcggcaattactagcggtttcttaaaggtgtttttcaacctggcggatactgtatcgctgttatcgccaaaggcactaaatgcgatcggtaacatgatcacgttgattgtcagggtacagatcccgatcgtgatagcactgtcattagcgccgaaaattaacggtaatacggccgagccaacgaagggaaccgaggggtcggcaatcgacattgcgcgtaggatggccacgggggcgtcatttgcttaataaagcaagcttacctgacgggggcgagcagaatacgaacgaaggccgttgtaaatgaccatgctataatgaagggaacatcaattcgtaaggaagttaagcatggaaacgcaacgataccttaatttaatcgaccgggagctaaagcaactgccagattttgtcagcgagtaccagctgggcacccgccattccctcaccacttcgtaccagtacctaaccgaactgcgccggttttttacctggctacgcaaaaccggcttaagcaaggccacggataacgcccacgtgacgacggcggaactggaaaagctacgccgcaacgacatcatgcagtttattgacgacttggcccacaccaaaaatgcgcagcaacgacttaattcgcccaccacgattaaccggtcaatcaacgccctgcgctcgctgttcaaatatctgaccgtaaccgccgacatcaatgggggccagccctactttgagcgtaacgtgatgctaaagatcgactccttaaatgacaccaagactctgaattaccgcgcccacgtcttggaggccaagatgtacaccggccagctcaagtacgattttttaacctttttagaccaggagtacgaacaaaagtgtgatccgcgcgcccggaccgcctttgaaaagaataaggaaagagacatcgccttggtagccctgatcttgggcaccgggatccgggtctcagaaacggcgggtgttgacgtcaacgaccttgatttaaaggggcagaccctggaagtgacccggaaaggtggccaacgggatgcggtcccaattgccccctggacgatgccctacattcaggcttacgccacgattcgccgtcagcgctaccaaccggagaaaacggagcgggccttctttttaacccactaccacgggcagaccaagcggatctcggtcaacgggattgaacggttagtcagcaagtactcgcgggcctttggtcatcccttgaccccgcacaagcttcgccataccctcgcctcggagctgtacgacgtgactaaagaccaggttttagttgcccaacagcttggccaaaagggcacctcggcaaccgacctctacacccacgtcgatcaaaccaagcaacgtcaagcactggatgaagtcggcagcgacgcaccaagtaaagagggtgactaggatgtgcacggccgtttccttttggtcaacggagcaccaccgctactttgggcggacgatggactttccggtcaaaaacaccccttggaacctcacttatttgccgaaggggtacctttggcgtcccctcgccccccaagccgcctacccctctaagtacgccattttaggcgggatgcgccgagtggatgattattacttaattggcgacggttttaaccaggcggggctagcggtcgccgagctttactttcccggccaggttgattacgccgcccgggcccaaccggggaaaattaacctctcaccccaggacgtgattggttacctactgggcaactgcgccaacattagcgaggtggcggccctgctaccccggttagtaattactaaccggcagtggtatgaccacgatatcatccaccccttccactggttcatccaggatgccagcgggacctacctattggaaccaactagccccaccctgtccttgcagcgagttgagttaggggtcttgactaattcacccacctacgccaatcacctgcggcggctccgttcctttctgggcttgagtgccgacgccccgcttaaaacggtggaggaagcgttaaaggattaccaaggtgatctgccgcaagctcgctccccgcgttcacggttcattgctacgagcatccggttagcgcaccaacttccggttgatgatcaccaagccgttgcccagtcaatgaaggttttgggggcggtgaagatggcgcacctgccgggtcacgatgacttcacccattaccttggaatggcggatctcaactccctgcgctactttttcactcccgttcctgaaatgacgacgattacacaatccttgccagccttgatggctaagtattcaacgccccaggtcctatcgcaagtaccctaaaaaaagcgccccgcggggcgctttttttatttctgggcctggtaagctttaaccccacgaactaagcgggctaaggcgtcttcaatgacggtggttgggtaagctaggttaacccggacaaagccctttccgtttccccggtactcagttcccggcgtcaggagcaagccggtttgttccctcaagaaggcaacgagagtgcgggagtcctccgcaacggcttgggtgtctaaccaaactaggtacgtccctcgtcccggtactaagctaagttcgggaaggtcagttgccaaaacctgttgtacgagttgacggtggtgtttaatgagggttttaagttggtggacccactcaccaccgttttcgtatgcggcaatcgaagccgggatggccagtaggttgggacccacgatctcctgttggttagctgcctgggcaaaccggtcccgtaataaggggttggcgataatggcggtcgccgcttgtaaggaagcgaggttaaaggtcttggaggttgatacgagggtaattacgttactcaaaatgactggatctaaagagaaggttggcgtgtagtcttccccctcaataaccaggtcaccgtggatttcatcagcaacgaccaacaccccgtattggttggctaagcgaatcatccgttccaggtccattttcgaccaaaccatcccagttgggttgtgggggttgcagatgataaacatgcgggtcttggtgtcggctagtttttcctctaggtcggcccagttgatttggtaggcgtggttttccctatcgtaatcttgttggctagcgaccaccttacgcccggttttttcaatcgccccgaaaaaggaattgtatatcggctccagcatgacgattccgtcgcccggggccgtaaagtaattcaagcaagccgttaacgccgggatgaccccgctcacgtattgcatccaagctggggcgacgtctaccccgtgctcctgttggtaccaggaagcgacggcggtaaagtactcgtccggggtgtattcatagccaaagttaccgcgggcaaccttggcttgcatcgccgcctcaatttccggtgccacccggaaatccatgtcggcaatcgttaggggcagctcgccgtctttaacgcgccacttgatcgaattagtgtggcgccggtctaagttagtggtgaagtcgtaaatggtcatctggcattctcctttccatgatggttgataagtaacaccagccattacgcttcgtttgaatataggtcatatcagcggtccatttttgatttaaaccagtggtcgagaaatcctgcttaagcaagttgggacgctgttcaaccttagttcagtcatcgccaattcagccactcaaggtgcctatttttgcttctaagcgattttaatataattatgcatgtaacacttaaaacggcttaaatgagtccatgtgacgttcaattccaagaacgcccattgtcagtgttctattcttcggggtgtttggccgcatattctctagccgcttgtttattccaccaaacgcaaaataggttttgcatggtgccatacaagtagttttcaacgttcttgatatgcttctcattacttctcagaacgttaaagtagcgtctcaaggctttagtcatcaaaggtttaggttcttcgtcgtcaagcgggattagaaccccaatatctttgtgatccttctcaactcggtacttagcatttaagataatgccaatgaaacggcgcatttgttgcggggttcgacaccaaaaaccgcaaaatttttcaaaaaaagacggcttgtgcaattttgcccaaagtaaatacacaagccgtttttcgtctcaattgttgttatatcaatggtctttgtcaattcataagtcgcccgtgaagaaaatcgaaatcccttccccggtcaatagttatctcctttcacgaggccgactggttcgtgaagaaaagtgatcaagtcccagcgttgtcttcaaccttgtgatttttacagttgcattcccagccaagctagcagcaagccgcccaggtaggaactggtgatgtataacagcgcagcgccctttctcccttcgtcaaagaggctaatcaattcgacgttaaaagtcgaaaaggtggtaaagccccccaacaagccggtggtccaaaacttgccactttcgcccggtaagtactggctcaaaagcccgaaggcaaaggaacctactaggttgatcaccagtgtagccagtggccagtcgattcttgttttcttccataattgcgttagctgccaacgaagccaggcgcccagcccggcgcccacaccgatcatgatcattgtgccttccccactttcttagcgagccaaaagcccaggccagccattaccaggcccgccaccgccgtcaccaataggtaggccaggcccaggacaacattagttgataatagccccaccgttaccgtactcatagtcgaaaaggtggtaaaggcgccgatcaagccggtcccgacgcctagattgacccagctgggaaaggcgccccgttcaatgccccagtacgtccaaaagcttaacaaaaaggccccgactaggtttactaacaaggtggcgatgggggttaccacaaccaggcctagtgccgcccgtaaaatgccgccgctaaatccgccgattagcacggcgctcccgtttttcatctattctaacctccattggtctaatcaaattctaataataagtaagaacaagttgattgtcaatggcttagggggacaagtataattatgaatggaaaaattggaaaagaggaaattggttcaatgaagatgcgcagaattgaccatgtggtattaccggtggctgacttaaacgtcgcccgccgtttctatcatgaggtgtttgacatgccggtgctcgaccagcaatccacggatgacgtggtgaccttacggtgcggccaccagctgattcgcctggagaaggttgaccgggacagtgacctggtcgccactaagcttgttcccggtgccgcagacctgtgtcttgttgccggtgacgacatggacgccattgtccaccacctgcggtcctactttgttgacctagtggcgggtcccgtcgccaaaaacggcgccgagggaccaatgacgtccgtttacctacgcgaccccgaccaaaacttgatcgagatcgccgtctatgaaaataaataatttggggtctattcaagcacttttaagatcgctataatggatctcgtttatttttgagaaatgaggtgttacgaatggttgtaaccatgaaacaaactgccaaggcaaccgaagccacttacatgcgcaaggcaacgctggaggatttagaccggatctgggagatcgttgaagacgcccgcgcccttttgaaggctgatggtagcgaacaatggcaaaacggttacccaacccggttaaccttccaacaagatattgagtttggaaactgctaccttatgattgcaggcgaccggattgccggcaccgttaccctgatgccacagggcgacacccactataactacatcgttgacggggaatgggcgatgcctggtcacccatttgcgaccattcaccggatcgccattgactcggcttaccgcggccgtcacttcgccaactacatcatgtcgacgatgatttccgtggcttacgcacaagggatccgcaacttccggatcgccacccacgacaagaacgaccgggtccacaacctggtccaaaacttcggcttcgttaagcgcggcaaggtctacacgggcccgacgccggacgacctgcgtaacgtttacgagttgaacttgaagtagaagtgcgaccaacctcctcgacaggtcgtagggctaagctagggcgaaggttggtgccctggcaccgttctttgcccgtacttagccactaggcctgtggttgggagcacgttattaagaagtgcgacccagccaacttgcaggccgtgagctaagtcagtacgtcggtttacactaaatttgaacaaacggccccccgctggacggggagccgtttttcatttcccccaaaacattctataatatagataataactagttgaaagggggcaccatgatggcaaaacaggaagtttcggcgaccaagcgcctgcgccaaatcgtcaacgtcatcagcaagaaccatttcctggccaacttctaccaccaaaccaacccggaagtgatcgtggccgccctggaggagttgggccccaccttcatcaagctcggccaactcctctccacgcggcccgacctggtttcaccgtcttacatttccgccctagaaaccctgcaagatcaggtccaagaagacgatttcgacaccgttaagaccaccatcgaggaatcgaccggccaaactttagcagagctgtttgccgactttgaaaaacatcccttcgcctcggcttcgatcggtcagtgccaccgggcccacctccacgacgggaccgaagtggtggtcaaggtccaacaccccgccgttcgccagctggtcgaagtcgacctcgccctcttcacccgggcggtccgcttgcttaagtacgttcccgagggcagcgtggttgacctgccccaggtagtcgaacaactgggccagtccctgcgctcggagattgacttcaccatcgaagcccaggccacccaacgcttttacgaactcaataacggccggggaattttcttggcgcccaaagcctttgtcgaccaatcatccaaccgggtgttggttacccaatacatgccgggcgaatcgatcaaggggctcttggccgacccgccgaccctagcccttcccgacggcctttccttaaccgacgttcgtaagggcgttgcccggtcactcgtcgaaaacttcatccaagaggtcttttacgaccgcttctttcacgccgacccccaccccggcaacctctttttcctgccggtgcccgcgggcagcatccaaaccaccacccagtttcaaaagcagtttggcgatttgaccctgacgattaacaatcaaacgcccctaccgccttaccggctggtgtacctggacttcgggatgatggggaccctgccggctagcctagcccagggaatcgcccaggtgatcttggccattaccactaaggatagctaccaaatcagccaggcgattttacggatttgcaaccaaaccggcccggtcgacgagcagtcctttaaccaccagttggccagcttcttacgcccctacctcaacaccggccttaaggattacaacttctcccagatgatctttgaggttaccagcctctgccgcagaaaccacctccaggttaagccggaagtgacgatgctgctgcgggcctttgggaccctggagggcacggtcgccaagctcgacccgtcgatttctttaatggacattgcccgtccctttgccaagcagtactttaaggagcactttaaccccaagcactttaccgaggggcaggcgctcaaactcttgcgggcagccggggccaccaccagtatcccgatccggatggcgaccttcttggagcaactcactaacggcgaacaacgcctaaacctgcactaccaggggcaagaccgggtgctggctaagctcgaagcgctgcttaaccgcctcttgaccgtgatcgtcttagccgccatcatcctcgcctcgtcgatcctggtggtcggcggcaccacccaccccctgatctacaaactgggggtcagtggttacctgctggcgatcatcatcttgctcggcttagtgattgccaacacctggcggcggttccaccgctagggcaaaatggtggcgtccgcttttcaaattggtctataatgatcaaaaaggaggaattatcatggcagaagaattacctagttacgcaagtaaagtgatcagcgtgcgtcccctgacggacgactacctcgaaatcctactcgaaatcccggctggtttcacctgggaggccggccagtacatgcgcttaggcctacccaccaaggaagtgaccgaccaaaagaaggtccgcgccctgtcctttgcgagcctaccggcggacggtcacatcctcttaggtacccggacccgccagcacggcgaaccttcttcgtttaaggccaacgtgcaaaccctggtgccgggcgaagaaatccaaatcctcggcccactgggcaagtttaccttaaaggacgaagacaagcccctcgtcctctttgccagcggggtggggatcacccctatccgcgccctggtcaaggaactccacgacactaagtcagaccgcccggtagaagtggtctacgtcgcggatggcttccacctctaccaagaggactttgaaaagtgggccgccgacatgccaaatctgaccctgaccctcttagaccacggtaaggacgccgttgcccacctgacggaactggcagaacaaaagggcaacgaggttcgttactacctgtccggttcaccagcgatcgtcgaatctaaccatgacctcctcgttaacgctggggtcgatgaagacctcgttgaagtcgacaagctgtacgggtactagcagcaagtggtgaccaaccaccctctcaataagtaaaaccggctaatccgcgtttctttgcgaattagccggtttttgtgttatctgagccgtaaaaacgattgcctcattttagtttctatccttagcccacggcctgccctatggctggatcgcacttccgataacgtggaaaatgaccacagacctagtgcctaagtacgggcgaagaacggtgccaaggcaccaaccttccccctagcttagtcatacggtctgtcgagaagatcattccccactccttgtgctttaatactgcgtaaattcgtggtttaagtgcatcaacaagccatccaaggcaccacgcagattggcctggttgccgaagcgggcggccagcaagtcaggcttggtaacgtcggccagcaggcgcgggtcctggcgttggagcgcctcaaactggtagtcaatttcggccaggagactgggttgactgctaatgccgccccctagcagcacccggtccaaatcaaggacggcttgaaggttgattaacagcagggccacccgccggcaaaaggccgaaaagattggccaggcccggtcgtcaccctcatcaattttttcaaagaccgcccagccgtcgtgggcatccttgatcttgcaggcgaccgccacgtcttcgatcatcttgacggctgaagtcgtggcgccaaccgtggtcgcgggcgtcggttcatcaaaattggtgaccattgcgctcacctggccggtttgaaagtggcggccgctcatcaagtggccgttcagcaccagtcccccaccaactgaggtgcccagggtgatcagggcgccgttttcgacccccttcagccgcccctgccacagttccgccagggtcgcacagttggcgtcgttaccaatgaaaaccgggcaaccacttgccaggcggatgtaactggccaggtcaaaggtccccatgaagctgagtgccccagtgaaagtcacggtcccttccatcgggtcaacaatcccgggtacgctgaccccgatgccgaccaccgagtcctcaagcttacccaccaactggtccagtagcttcaaaaagtcctccttattggtcggggtggcgacgctgcggtgttcttgcatcttaccgccgcggtcaaagtgggcgtacttggtcgccgttcctccaatatcaatgctaaaataacggtgttccatgacagacctttcccttcgcttttctttttattatagcttgtttgcgcttccaattgaaagaaggttgttaaatgaacgacgattttctgcgtggctactaccagggcgccgtcgaaaccgccccggcgagcctgtccgcatacgatacggcgaccctggcgatgacgatggtggtccaacacctccgtcacaccaacttacccgaagaacggatcaccgacctggtcaatcacctgctcttcgctaccgccggcgaccccaccacggcggcgcggttactggaattaaccaaggcggaactggagtccctcgccgcccgcttaatggccaaggggctcggcaaataaaaagagcccgcgggaatcgttttccctcaggctctgccattttcttgaactgtacaacattcggcgtcgatcatcccgggtacgcaatcgcacgggaccgcatccggcgccgttttaattttttcagctaggatggcttgcagctcctgcaggtctgccaccgacatcgttgaccgttcgactaagtgcctaatcgtcttgcccgcccgcatctggcacatggcgtcgaagagctggtcgacggcctggtccatcgtgttttgctccggaatcaggggcgtgtaaataaaggcccgcccctcctgggtggttttcagcgccccttttttaaccaaccgccgcagcaatgtcttgatcgtggccggcttccagtcgacccgctgctttaaagcgtcgatcacctgggcgctggttacctgccccagggtccaagcgacccgcatgacccgccattccgccgggctgatgtccatttgttcgttcacgtcgggttccccctttccactccagtttacaagtgtactcgtcagctggcaaccgtttcggccgttaatcaaattggtctagttgtgaacttgagttagttgaccggccggcgccccgctttggttcgttccaattttacaaaagaagggcgttgctttttcaattaagcaagctcaccaagcctttaaaatgggcgtttcttaatggaaattgggtgtggatttgctcagcggcttctcacgataaacttagcacaatcttatcgccgctcccgataatctttgttatcataatcgtggaaacaagaaatggtttaaataaaaaggagtggtcatcatgatgtctacaatgagtaatgtaatcgcaatcgtcacctttgtcgctttaatcattgcaaccttaacccactcatttaagctgcgtcactaagatcggaagtgggatacaacggaccggatgtaagactatgcgaacggttgtatgaaccgcaccgttcctcgccctacttaggcactaggtctgcggttggttacaccttagccgataaacattcatcaatcaaaaacgggctggaagaaacaagcttccaacccgatttttgtgtagccaggggttaacctcaaccggatcttgatgatgtcgccaggcaccagggtggcagcgtcgatcgtttggtacttaccgtcccgtaaggcgttggcttggggggctattccctttttcaacgccaccaacgcgctggaggccttttgcgactgccagaggtcaatggttacgttgaaaatcaacagtagcatgatgataatgaagtcgtcccagtggccaatgatggccgaaatgatggcggcggcttcaatcatgtactcaattggccccatgaaggcatggaccagcttgtgggtgaagctttcttccttttcctccagggcgttggcgccgtacttttgcaagcgtgcttgcgcctcgcttgccgaaagcccagttttagcgtcagcccccaaatcttgcattacctgatccagcggggccttttctaggtcaaccccgctggtttttatagatagcgaatcgaccaccggttttaattagtggcaaatagcataataacacgggaatttgcaatcctattaagctttattattataaagttgtttatttgcaatttgccaagaaaacgggtgcagtatggttaatcaagtgataaggaggccaaaaaaggtgaaatatggaccaacgatttcggatatccgtaaagccaagaagatcagcttgaagaatcttctgcaagaccaaatgaccccgtccagttacagccgcttcgtcgacaagaagaccgagacgtcggtcaataacttcgtcgcactccttgaaaacctcaacgttaccttcgatgaatacctctacatcaataacggttaccaaaacagccgctacgaccaactctaccgcaagttaaccaccgctctgaaggccgatgacgccccggccctgatcgtcctcgttaaccagatcaacgcctttgcccagagcagccccgacaacttgcggatgaaaaacctcttagacatggcgatgctcgccctcaaccacgttcaaggcgacccgcttaacccaaccgccagagaggacctggtcaagtacctgattaattgcgaaacttggacccactacgagatcatgatcttttacaatttcatcttcatcttcgacgttgaaaccgtgatcgtgatccaaaagcggctgatccgggtcatctcccgctacgataacctgcgcctttacgggagcgaacccttccggaccctggttaaaatcaccatgttttacctcgagcacggtaaggtcttagaagcccttgaatctttgatggacctgtgcgactttgacatccaagaagagttcttgtttgagcggacgatgtacaagttcgtcgccggtgaaacctacacgatcaccaataccaaccgaatcaaggcgatcgacgacgccttaaacatctttcaggcggccgggtccacccaccaggtaaaccgactggtcgatcacataaagctggtcgtcaaggccaaccagttccacaacgatgacttcgacgctttgatcgaaaagtggggcggcaccccatcgacgaagacaccgaccaccaccaccgtttcctaacccctccccagtgacggaagattccgtgaccggggatttttttgtccccaaatgaaagcaagcctggtaaggattttgggaaatccttttcctaaaattgccaaatgggtgttgacagcgttttcaggagtggttagtattggtgtatcgataaaccagagcgctttaatcagctgctctcatcgaggaggataagagatatggattatttgattggtgttgacgttggtacgacctcgaccaaggccgtcttatacgatcaacaagcaaacgtgcttcaggacttcaagcagggctactcgctgtaccgggacgccagtgggatggcggagcaaaaccccgacacactggtggaagccgtccaaagcgtgattaagcaggcggcccaggcggctaaccttgaccaagggaaactcttagcggtttctttttcttcggccaaccagagcttgattttgctggacgacaagcaccagcccctaacccgggcgctgacctgggccgacacccgggcccgtgcggtggctgaccagctcaagcggacgccggctggtaagcagctctacgccagcaccgggacccccattcacccgatgtcgccgttaaccaagctcttgtggcttaagcaggcccaccctgatttgatggccagggctagctactttgccgacattaagtcctacctgttttacaagctgtttggggtcttcaggtttgacgtctcgatcgcttcttgcaccgggatgttgaacgtaaccaccggtgactgggacgaacgcgcccttgcgttaaccggggttcaaccagaacagctccctgaagtcgttagcggaaccacccaggaaattggcctgctccctgacgcagccagcgcaatgagcattcccgcccaaaccccctttgtctacggggcctttgacggtgcgctgtctaacttaggggtcggggcaattgaaaaggacaccgtcgccattacgattgggacttcggcggccgtccgggtggtcaccgatcatccagtcattgatcctaagcaacgcctcttctgttacgccgttgataacggcctctgggttgtcggtggccccctcaacaacgggggtgacgtcttccaatgggcggtggaacacctagtcgatgcctccgccgtccaaaacgaacaagtcgacgcctacgaactggccaacgacgtcatcgcctcggttccggccggggctcacgggctcttgttccaccccttcttaggtggggaacgggcaccgctttgggacgccaacgcccgcggtagtttcttcggtctttcccaacttcacacccgggccgacatgctccgggcggtaatggaagggatcaacatgaatattgcgaccgtctttaccgccgttgccgacctggttggcaagccgcgcacagtaaccgccaccgggggctttgccaactcggaagtttggcggcaaatgctcgccgacgtcttaaactgccccgtcaacatcccgaactcctttgaatccgggtgcttaggggccattacgatggcgatggtgtcgttagggatggttgacgacttgagcgccgtgactaagttggtgggggaagttaaatcctaccaccctgacctaacaagcgtggccacctaccaaaagtacctccccgttttccgccaggtggaaggacttttgtcgccagcctactctaccatcgcgaacttgcaggaagattaatcatttaggaggattaattccatgccattattaattgttttacttggtgttatcctgttggtcttcatgatcgtcaagctgaagcttaacacctttgtttccctagttgttacctcatttgtcattgccctgctcctccaaatcccggtcgctaaaattccgaccacgatcgaaaccgggatcgggggccaattggggcacttagccatcatcttcgggtttggttcgatgctcggtaagctcgtttccgattccggtggtggttaccggatctcgacgactttgatcaataagtttgggcgccgctggattcaattagccgtcattttggcctcctttatcatcgggttggcactgttctttgaagtgggactggtcgttgtcttaccgatcatcttcatcattgcccgcgaattggatatgccgctgatgtatctgggggtcccaatggccgctaccttgaacgtgacccacgccttcttgccgcctcacccggccccgacggcaatcaccgaaatcctcggttctgaaatcggccacgtcctcttgctcgggatcatcgctgccatcccaaccatcatcatcgccggaccggtctttaactgggtgctccaacgggtttacccgaaggtttaccgcaaggacatcgacatttccgtgttaggccactacaagaccttcaagctggaagaaacaccgggctttgggatttccgttttgacttccatgatgccggttatcctgatcatcatcgccaccctgtgctctttcaccctgccaaagggcaacgtagttaaccaagtgattcaattcgtcggggcgccagacgccgctatgctcttgtcaatgctgttcgccgtttacacgatggggatcaagcgaaacaagaagatggacgaaatttccgaatccatggtggcctcggttaagcaaatcgccatgatgctcttaatcatcggtggtggtggggccttcaagcaggtcttagttgacggtggggtttccaactacgtttcgaccctcttcgcccacaccagcctgtcgccaatctttgccgcatggctgatcaccgccattctgcgggtttcgctgggttcctcaacggtttccgccatgacggccgccgggttaatcgccccgatggcccaccaattcggtcacggttccgccatgtccgctttgatggtgttggccgttggtgccgggtccgtcttctgcgaccacgttaacgacgccggcttctggatgatcaaggaatacttcggtctttccttaaaggaaaccttcctttcctggtcaaccttgacctccgtcttatccctggccggattagcaacggtttacggcatgtcgctcttcttagcttaattcactttttctttccggactcaagccattgtgcttgggtcctttttgcttttgacaatcactcgcccatggagcgttgcatcgtggtaaactaggtttattagtcttacaagggggagttacaaggtgcgacgattaacaattaccgacgtagcccgggaagccggggtttccaccaccaccgtttcccgttacttaaacgggcacttcgaaaaaatgggggaagaaaccaaggagcgggtggccaagaccatcaagcggctcaactacgccccgtccgcctcggcccaaaagctccgtcaaaacgaaagccacctggtgggggtattggttggtgaaatctctaaccccttctcttcgctgctttccaaggggatctacgacgttttacagggggccggctacgatatcctcctgatgaacgccgacaactcaacggcgaccgaagcccgggccctgcagcgttttgtcgcccaacaagtcgatggggtcatcgcccagcccagcgccatccattttagtcagttccaaactttgaccgatgccaacatccccctggttttagttgaccgggaggtaccggatcagcccgccaccgttggccgggtgacctccgccaaccaggacgcctgttattacctgggcccaaccctagtggagcgcggctaccaaaacatcatcaccgtctcggcccactttgccgaggcatccgggcagatcccccggatcgccggtttccaaaaggctagccgcacctttggctttaactactccaacattgaaactaagggtcacgacaaagcctggctgcgcgccaccctctcccatcaattagcccgtttgaccgggcgcaccgtcatcatttccctgatggggccggtcttgtttgacctactcgccgtctttaaggaactggggcttaagttccctaaggacgtggggctggtctcctttgatgactgggagtggtccagctacgtcagcgacgacgggatcttcttgttacgccaagacatggaattgatgggcaacatggctgccaccgccctgttaaagcagctccaaaccaagaccttaacgagcccaaccaccctgctgccggtgaccaccattgaccgcccatcattataaggagatgataaaatgatcaagttaacggtgactcccgctgccgccgactggatcaaggaaacccttaaactggttgtcggaaacggagtcaatttttacccggacccggataaccaccacccggttattcatgggccgcaccaactgtacgccatcgataaccaccccgaccgcgtggtagctaaagacgaggtcagcggtattaacttccacatcaactttgaagacgagtggttctttatcggccgcgaaatcacggttgattaccaagccactgacggactaacctttacctttagcggtaacgacgccaacgctggcgccaccatcaactacgaaaagtttctaatgtaaggatagaaagtgggatagaacctgtaattctcggtccctgcttctgtctaggattcaaaaatataattagcggcggagagaaacgacttgtttttctccgtcgctttttgattgacgttagcaagtgaatggtttaggctgtttgccggttttttattggggtttagttatagtaaatatctgcttgtccgttaatgctaaaaaaagaaccgcgggattcgttcccacggccctaattaagctgtctttagtttacttttggtggcgtttgataaaatccccaatccgcttgatcgcttcctggagggtcgccaagtcggtggcgtaagaaagccggacgtggccgtctaaaccaaaggccttccccggtacgatcgagacgtgggcctcctctaagaccccgttgacaaattcgtcagtcgactgaaagccagtcagttcaacggcctcggaaacgtccgggaagaggtaaaaggcccccgcccccttagtaacgctcacgccaggcaagtcgttgatcagtgaggtaatcgtgttgagccgctcttcgtatgcttggcgcatcctttcaacttcttctttcccccgcgggtcggtcagcgccgtcagggcggcgtactggctaacggccgccatgttcccactcacttggcctaggtaggtacctaaggcagcggcaacgttgcttggcgccaccgcgtaacctacccgccaaccggtcatggcgtaggacttggaaaaaccattgaccaagacggtgtggttaaccacgtcttcacccaaatcaaggacggaggtgaactcggtgccgttgtacactaggtcgccgtacatgtcgtcggctaagattaccaggtcgtggtcgaccgcccagttggcgattgcggttagctcgtctttggtgaagacctccccgctcggattattcggggtgtttaagaccagcagcttggtctgcggggtgtagacggcttcgaggtcttccaccgtcaccttgagcccttggctggggtgggccaagacgggcttggcgccggctaatttaatttgttcgccgtaagaaacccagtacggaagcgggatcaacgcctcgtcgccggggtttaagagggcctgggtcaccgcatacagggcaaacttgcccccgttagtaaccaccacgtcacgggcgccaaagtcggtcccgtgctgttcattaatgtggttagcgatcgccttgcgcagcggtaagatcccggtggctgccgtgtaggaatcggcctcgtgttcttcaatcgccttgatggcggcttggccaatgtaggacggggtcttgaagtcgggttggccgaccgccaggtttaagacgtcgatcccctgggcggccatttccttagcccggttagaaaaggccagggtggccgatggttgaatgtttgcgatccgttctgaaagttccacgattaatcaatcctcctggtgtttaactgccaaaatgcgaacaaaaaatgcacttcatggtcaaattataccatcttaccacagaaaccgggaggggattttaacacggagccaaaaacgggaccgggagaaaaacggcttctcccggccccggcggttctttttaactgtgagtcagcccgcccagtctgctcccctggctcacagggcaaagggcctgactaagtgggtcagtggggtgtggtcagacactttaagaaccaagtaaccaccaaagacgccgagggtgttgctgatcacgtcgtcaatatcaacgacccggtttaagttaaccgctagatcggccactagttggcaggattcaatcgctaagcccggtagcgcacagagtaagaggaaggccacgggggagaggttcggtttcgctaggtacaggtagacccccagcgggaccgtcatcaggatgttggcgtaaaattccgcatcgacgtaggctaaggggtgcaggttgtacgaaaccgtaccaaagtaagagagcggcttatcgagccccgggaaaaagggcatcccagtcgggtaaaaggttagccagattaaaaccgctaagtagcaaaacccggagctaaccgtgatccactgggccgcccggtaacgttgcccggcaatgcgcccccagtaaacggcgccgaggatcagcagtaaggttgctaacggtaaccacctttgatgcatcatctgtccttcctcctttccagttattaggttttattataccggttgaaccatgataaaccaggttttacaccgatcgttagcctttcttattatttacgccggttaatttgcatcccgatcaaggagccaatgataaacaaaacgaccaggactaggataaacgtaaccacactaccaccgcctttcataacgtttcgattgtaccgacccagccgggcggggtcaatcatttttaaaagttgatggtgaaatcatgacctaacttgtataatgttttcaaacgtcacaagagagggtgatttgatggaatcaattgaagcgatcattcaacaacagcagttagcaggtaagttattcggcggctttttcggcctggaagtcgagcaacaccgggttttaactaacggtaagcttagccgccacccctacccggcagccttttcgtcccggcgccacaacccctatttaaagaccgatttttgcgataatatgtttgaactagtggcgccccccgttcaaggggccacggcggcggtccaaaacctcaagtacttgcaacaaattgtcaatgaccacttggcagcagacgagcggatctggcccctgtcgattatggcgcccctctccgccgatgacctagcctttgccaccaccttcaatacccgtcagtggatggctgactaccacgactacctgggcgcaaagtacgggattgcccgggaactgatggccggcgtccacgtcaacttttcgctccaccgcgacctcatcgccgccctctttgcggccagcgggcaaagcgatttagcggcctttaaaaaccacttatacttccgcttggcccagggctttgtcgcccaccgctggctctttacctacctgtttggggccagcccggtgctggctaacccactcaaggggatgccggataacctcgccttcccggtccgcagtttgcgcagtagtgactttggctacaccaacttttccagcgaaacgatcacctacagttctttgggtgcccaactcgaccaactcaagcgcttcgtcgccgaagggaagttctactccctgcacgaattctacggtccggtccgcctcaagagccgcggcgctaactcggacgacctgattgcccacggaaccgagcggctcgaattccgggcctttgacctcgacccgctttcccgggcggggatctcaaacgataccctcaacttcttggaggtcttcttagcctactggctggttgccgaccaggaggctgatctaacggaggccgacgagaaaaaccaagccgtcgccctccaacacccccaccaagaattcgactggaccaaagaacgcggactggccctgttagacgacctcgacgccttcgtggctaagtacggggcgccaaaggaataccaggccgccctgctctttgcccgccggcgcctggaggatccgcgcctgacgatcggtggccaattaatcgacaaggccgatcccgacggcggcctactttcttacggcctcaagattgccaacagccaccacgactggtacaagtccatggcgtatcccttacagcctacgatcgccacttaccccgccccggcccaagaactgatcaaggcggccatcgagttggggatcaaggccaaggttacccaaaattcctttgccctcattttgggcgatcaccaagaacagtacgccgctaaccaggcctttgacctgacgaacggcgccaaacaagcggtgctggtggccttccccgaacaggtcaactacaccgatcaagtcgaccaagttcaagtctgaggaccagctagtcggggcgctgccggtttaaccaggaaattaattgaagtgctttcagtaggtgcctataatggaactaaaacttactaaaagaaagttaaaccaaaaggatgatcttgatgaccaaagtattactaattggggcgaccgggatggccggtcaagaaatttaccaagccgccactaaggccggactggccgtcaccgcccaggtccgccatgccgacagggcacgggaactgtttggtaccggcgtgaccgttttagaacaagacgccctgaccctgtctaaggacgaactcgccaacttcgacgtggtcgtcaacgccttttcaactagccccgccgaagccgacaaccaccaaaagctagctgaacacctcgtccaccgtctcggcggggatcagcggctcttggtgatcttgggggctggctcgttgttagacggcgccgacgaccacctggtggttgatgacatcaaaaagacccccggggccgacgcttggatcgccatccccgaggggcaaaaaaaggagctcgactacctgcggaccttatccgggattgactgggttggcatctcgccgtcctacaccttcaaaccgggaccggcgagcgaccagatgctcgtcggcaacgaccacctgcttagaaacgacgccggggaatcctataccaccgccggcacgatggccaaggcaatggtcgcagagatcctccacccggcccaccaccgcgaacgctccacggttgctaacagctaactaaaaaggacaccaacaattcggtaaacgaattatggtgtccttttttcgttggtctgtgtaatcagggggaatcactgttaacggacctcgggggcgtttcccactcacctattttttaatcatcattgctactaaagatcaccatttcagccatgataatctcccggtaaaggctggccattgccgggcggtacttctcctctagttgagtcaccatcgctaggtagccgcgctcctcttgaaaagccaaccggtacgcttcttcgaggagctggcgctattttatggggagggctggtttggcgacgacctggcggacctcctggatgaactggcgggtcgttgtgttagcaatttgggcgttcaagtcgtacagcacccggcgccgaaggtcttcgggcaggtaaatctgcttgatacgggcaatcgcctggttaaccatcgcctggcggaccttagtcacttccccttctagtttggtgtcggtcgtggtcggctttaagatcaaccgaaaaactgccgttggatcacaattgaacataccacggctaaaatcaacagcgccgttgaatacagtagtaccaccaatatcaacctcccgttatcgtcctcaaattataacccacttcagcgttcagttgatattgttttgacttgaaacaatgctaaggggcccggagaaagccattcctttccctgggccccttattttgattggcaaacgttagctcaagacgtggtaactaacaatggggggcgtttccccctgattacattttcttccaaatctcctcgtcaaagtagccgaggtggttgacctccagggtctttaggtaggcgattagttcaatcgcggccgaggcgctcagttggttaacggcgtttaagccggtcccaattggcaccacgttgctcatcgccaccacgtcggtgccgttttcaatctgcacctgagaaaaggtgatcgaccaccgtccccgcatgttcggggcaaagacaaagaagaggttgtaatcgtcggctaagtatgccggcatggcgtaggcaaccttgtcgatcggttcgggcaagaggttgccctgaaaggcgaagtgatcaaggttaagggcgttgaccgggttattaagcataaagaccgtgttttcaaactcgggccggccaagtttcatctccggggtaatggtatcctttaagcgcatcagattctcctaactgaagttggttcggtaaaattcatacttttggtgaatcgactggaggggttggtccatcacgtgttcttccccttgatcatcaaccaagaaacgctcgcggaccttttgggtaaactgcagccgcactaggggtgccttttgaaagacttgctccaggttggtccccatgatcgccaggtggtcacaataagtcggcaccagcatctgttcgaggtcaccaaacaagtcggccaagacgtcggcgtaagcgcgatcggcgtagtggcgttcgttctcctccaggcggtcgtagtactcgacgttggtgagccccttttggttttcgatggcgtgtttctcatcgtattggtgggttaagtaggaatcccaatcgcggtaggcgtaggtcgtcaggtgtaagaccaaatcgcgcccctttttagtgacgttttccgggaccatcccccccttaggatcctttaggtaggggcgtaccagttcaagcgctactaggtaataaaaggtccccggcaagagttcttggtcttggtcaggtgaataaaggggtccctctccttccaagagcggcaggccaataattgataaacgggtttggttgacggcgtagaccaggtcctcaatgtcttggtcaatttcatcgcgcgccgagaccgcctgtaagacgtgggtgaagaggcgggagagttcgtttttctcctttttttggttgggatagtaaccagcttggcgctcgtacttccgggtgcaacgctccagttgctcctctaaggcggtcgccatccgttccacttgcaccggtagggttggctctttcaccccttctttggccacctggcgaacggcttcgcgtaggaccggccgcatctcaatgaagtctggaaagtcaaagacgttttgaaagtcgtaatgaccactcggatcgacttgtactgggttcagctggtaattaaattcagtcatggtgtaccccctttttaaactagcttaccaagtcccctgccgccaatccattagggaaacaactaaaaatagccgaagaccgacgcctgaaacggtgtgatcttcagctattgaattggttattgaatactcactcgactaggaaagcttcgccgttgggcgctggacgactaaaaggagaattaccatgaccatgttattaggatcaatcgaagctggtggaacgaagatggtttgtgccgttggaaacaccaactaccaaatcaaggattccatccacattccgaccacgacgccagaggaaacgctgggcaagattatcgattacttcaagcagttcgataacctgtccgctatcgggattgcctcctttggcccgatcgaaattcgccgctcctcaccgaagtacggttacatcaccgacacgccgaagccgggttggtcaaacgtggatttcgttggcccaatcaagaaggctttgaacgtgccgatcgcttggacgaccgacgtaaacggctccgcttacggggaatacctgatggcaaccttatttaaccgccggattcactccctggtttacttcaccattgggaccggggtcggcggcggggccgtcattgacgggcacttcgttggtgaacagggccacaccgaaatggggcacatccgcgttaagcgccacccagatgacctagactttaagggaatctgcccgttccacggcgactgcctggaaggtttagttgccgggccaaccttcgacgcccgcttaggcaagccggggaaggaattaccgctgaccgaccacgtttgggacatcatggcatactacgtggcccaagcggctttagatacgaccctgatgtaccggccggcccaaatcgtcttcggtggtggggtcatctccgaagacttcttaaagaaggtccgggtggaattcaagaagctcttaaacgactacgtggaagtgggcgacctcgaccagtacatcacgatgccgatggccaaaaacaacggttcggccacgatcggggactttgccctcgcgttgcaggcggccacggaatagggagtgcgacagaaatctctgatttcgtagtcgcacccccgcaaacaccaataggacttcagcggggtcgccagaaccaatggagtccattggtgtactgcgtttaaagtgcggaccaaccattggcaggccgtgggctaagctagggggaaggttggtgagcacgttatctgagtaaccgtaaaaaaataagcatccaaaataagccccgtcacgttcgtttaacgaacgcggcggggcttttaaatttacctgcagcggaggttgggtcccgtttcttttaactagaatttcggcttataccgcgcaaagagggcgattgctaagatggcggtcaaaaggtcggccacggcctgggcggcgatgatgccgtggtagccgaagaagtgggcgagaatgacgatggccacggtgaagatgatcccttggcgagccagggacaagagcagggcgggcagagccttgcccattgactggaagacggttgtaaagaccagggtgaagccggctagagttgaagagataaccagccagcgaaccatgatggccccctccttgacgatcgtcgggtccttcatgaaccaggtgataatgatcggggctaagaagaacatgatcgccgtcatgaccagggcaaaaccacagaccactaacaggtcgaagcgcagggcactctggaagcggcggcggtccttggcgccgtaaacgtaaccaatcagtggttgggccccgaaggcgaagccaatgaagatcatgttgatgatcatcgataccttaagggcgatccccatggcggcgacggaatcggcgccgtagtcaattaggtagcggttggttagggccatcgctagggtggccatgacgttggtgatgctagcggggattccgatcgcgtagatttggcgtttgaggtcccaggagaccttggtttccttgatcgaggtggtcagcttttgggacttggtgcgcaggtagtaaatcattaaaaggtcaccaattacgttggaggtgacggtggccagcgccgacccggccgcccccaggccgagggtgaagatgaagatcgggtttaagacgatgttgataatcgttccggtcatcgaggccttcattgattctagagctaacccctcggtgcgcaagatgttattcggggccaggccaaagacgacaaaggccgccccccaggccatcacggtgtaatattcatcggcgtacttccaagtggccttgctggccccgagcaagtgcagggcctggtccttaaagattaacattagggcggagacgatgatgccccagaaaaaggcggcgtaaaaggcgtagccagacacgttgcgcccctcttgatcgcgtttttccccaaagaggcgcgagatcacggacgagccccccagtccgaagatgtcaccaatggcaattagaagggtgaagactggggccccctgcgaaaccccggcgaccagggcgggattttgggtttgggcgacgaagaaggtgtcgaccatgttgtaaattagggtgacggccatcgataaaacgaccggcatcgccagcgtaaagtagacgcggcggatcgaagtgtgttcaaatagttgctccatggtgggtttcccttcttaaaaaatattatatccattgtaggagaattgcgaaggagcgtgcaagtgcaaaattggtctagtcgaaaaaataagaagttggaaccgctaccaacttaaaaaagccccgtttgaaccccaccaaacaaaagatatccacaaaccaagcggcgccccttgcgaaggtgattagaatggtctaatcttatcaacattaattcggaaggggttgaagaaagatgaacgcagcaaacgtattgttcgtgatggtcgcaagcatcctggtctttttcatgacaccgggcttggccttattctatggagggttaagcgaaaagaagaacgtggtcaacacttttatgtcggtgtacttcatttgcggagtcgccgtgattatgtggatcatcgttggctactccctgtcgttttccggtaacgtttggggattgttcgggaatttacactgggcgatgtttcaccacgttaacatctttgccctgacggccaccaagattccaaccggcctgtactcgatgtttcaaatgatgtttgccatcattaccccggccctcttcatcggggcagtggttggtcgggcccggccgtggttcatcgtcgccttcgtcatcttctggtcgctcttggtttattacccgctagtccacatggtttggggcggcggcatcctcggtaagctagggacgctcgactttgccggcgggaccgtcgtccacatcaacgccggggtgacggccttggtcctctcctggatggtcgggccgcgtttgcaacgtcacaacgaccaaccggccaacttgggcttggttttgatcgggacttccatcctgtggctcggttggtacggctttaacgccggttcggccctagcgattgacaacgtggccgttcaagccatgttaacgacgacggtggccaccgcggcagccatggtcgcttggcaactactggaagtcagctttaccgggaaggtttccctagtcggtacctgcaccgggaccgtctgcgggttggtggcgatcacgccggcggccggctacgtcaccatcagcggggcggtcatgatcggcctgggggcgtccatttgttcctacctcttcgtaacctacgctaagccacgtttgcacctggatgacaccctagacgcctttggctgccacggggtttccgggatctggggaagcatcgccaccggactctttgccaccagccaggttaactcccaagttaccgacaacggactcctgtacggcggcgggatgcaccagttcttagttcaaatcgttgctaccctagccacgatggtctttaccggggtaatgtgctggctgatcatcaagggcctgcgcctcgtgatgccggtacgggtttcggccagggaagaagcggtcggcctggacatcacccaacacggcgagcgaatcatggcccgctaatcgattattcttcaacccaacaatgaaataagggaccgagaggaaacaacttttctcccggtcccttattttttagtttttagtcaaaataaccatcattgcggtggtcaacgaagtggtgataggcggaaatacatccgggattggtaccaaatgggggccatctagtgaaccaagcattgtgattcctaaccaaaatctctctaattcacccccgggagcgtcaattaaatggtaggcaacatcctctggtaagcagtagtgaaagttagcaggggcgtcaggatacagtatctcgttgaccctttggagatcattaatggttacgccatttggaaagtgctcccagaggacggcggggtcaatttgcatggcaagagcgaggcggttcgtgaagttggtttgcatggtttgttcagccctccgtttttaaagttattgtgcccgaaatgataggggaggacaaagaaaagggctaggagaaattcttctcccaaccctagcttagcccacggcctgcctaatggctgggtcgcactcactcataacgtgctccccagccgcagacctagtggctaagtccgaccacagaacaccgcgtaccgcgataacctgtgttctatccttagcccacggcctgcctaatggctgggtcgcactcaactattcaaagtacgccgccaacttctccggcgtcagggtcgccttgtctttaccggtcaggtcggctttgatctggccgtccttcaagactaagagacggttgccatagtggatggcgtcttccatgtggtgggtgatcatcagggcggtcaacttgtcttcgcggatccgctggtcggtcgccgccattaaagtggcactggtgtgggggtcgagcgcggcggtgtgttcgtctaacaagaggatgtcggggcgctttagggtcgccatcaaaaaggagagcgcttggcgttgacccccagacagggcgccggtggccgtcattaagcggttttccagcccgttattcatcgtggcgaccagggtcttaaattcggtcagccgggacttgaggcggcggaagaccaggtggcgggcctgaccgcgtttttcggctaacaagaggttttcggccaccgtcatccgcggcgccgttcctagtttggggtcttgaaagacccgggctaagaacttggtccgcccctcctgggagaggtgggtgatgtcttggccgttgtggagtagttggccgccgtccgcggtcaggttgccaccaattacgttgaagagggttgatttccccgccccgttggttccgacgatcgtgatgaagtcaccggggttgatcgtcaggttaatccccttgaggatcgtggtttggctggcggtgccgcggttgacaaccgtggtgacgttttttagttcgagaattggtttagtcatgggtggcaaccccctttaagattggctttttgatgtttaagatccggtcaatttgcgggatcatcatgcataaggcgaggacgattgcagagagtaagttgaggtcgttggccgaaaaaccgagttgcaaaacggctaggaggatcaaccggtagaggatcgaccccagggtaacggcgaccaggcgttggcccagcgtcagttcgccaaaggctacttcaccgatgatgatcgaggccagggcgatcacgatggtcccaatccccatgttgatgtcggcgtaaccgttggactgggcgattaaggcaccccccagcccaaccatcccgttagagatcatcaagccaacgatcatcatccggtcggtccggatccccatcgagcgggccatggtggggttatccccggtggcgatgaaggcctggccgtaatcggtgtttaaaaagaagattactaaaaccgtcacgatcacaatcacggtgaaaccgagcaccaccgagtcaaagtactggggcaggctctttaagaaaccgttggaaaagagggtggtttggccgagcagggaggtgttggacttgcccatgatccgcaggttaattgagtaagcggcggtcatggtgaggatcccggctaagaggctgggaatctttcccttggtggttaacagcccggtgactaatccggcgagcattccggccccggtggcggctagtgaagccaagagcgggttgaccccgtggacgatcagggtcacggcgacggccgccccgagcgggaaggtcccttccacggtcatgtcggtaatgtttaaaatgcggaaactaaggtaaaggccgaggccaagtagcgcccataagagcccctggccgatggcggatgtgattagagtcattatttaaatacctccccgtgatcttcggcagccttttcgaaggcctttggtaccttgaggcccagcttattagcctgcttgaggtttaagactggttccccgtgacgaatgtattcgatggcggtggtttccggcttggccttgccctttagaatggcgacgaccaccttggcccctgccaccccgagcttgtactggttgatactgtaggtggcaaccccgccgtctttgaccatcgtgtcggccgccgggaagaccggcttattagcggcgtcggcgtttttaactagcgtttgcatcgccccggcaatcgtgttgtcggtgggcacgatgacggcgtcaacttcagacagcatttgctgggaaacctggtccaagtcgttggagttagcgatcgaataggacttaaggtttaagcccatcttcttagcctgggcgacgaattgcttgtgttccgattcggctgacgggtccgaagaagtgtagatgatcccgagggtcttggcgtttggcatgaactggtggaccaagtgcagttgatcggcgaccggggcctggttggagatcccggtgatgttgccgcccggctttttatcatttttaatcaggccggcgcccttcggatcggtgaccgcccccaagacgatcgggatcttcgtggtggcgttggctagggcctggctggctggggtggtgatcccaaacaggaccgtggagtggtcattcaccagcttggtggccatcgtctttaagtttgactggtcgccctgggcgttttggtattcgatggtgacgtttttaccgtccttgtagccctccttagctagttcgtcgacaaagcccttgtagatttggtccagggccgggtggtgcatcagggttaagaccccgattttaggcttgctggtggtggtgaggctgcccccctccttaaagaaggcgacccccaaaaaggccacgagcaagacgatcagtgtgtacatccgcttcattgatttttctcctttccaaaataaaaggggtccgcgtttaacgggccccttttgggaaaaaagaaacgcccgtacgtggatccgtacgagcgccaaagtatgctttgaagccggtacagatgcaatctgaaagatcccaggttgcatccgtaaacggtcaacctgagttaccggctttgccaggcgttattcacttggataaatgggttactcatgttgactgctcctctcgtttgatttgtaaccactataccggaggggcgctcaacctgtcaactaaaaaatgagaataatttaatttgtttgttagaaagtgagtgcgaaccaaccttctcgacaggccgtatggctaagctaggacgggggttaacgcagaatgtgttgttctccggcctgcttaggcactaggcctgtggttggtgagcacgttatctgtgtaacctgcgagaatagggcctggggagatttcttccatgtgcacgattattggactggttggttcgcacttcctattagtgttacaattaatcattagactgaaaacgggggattgattttcatggcagtactagacgtgtccggtttgacgatgagcttcgccgataaaaagctctacgatgacgccaacttccaattggaacgcggcgaacacatgggggtggtcggacaaaacggggccggcaagtcgactctaattaagatcttgatcggccagctcttaccggtcgccgggcgggtccagtggcaaaaaaaaaccaagatcggctatttagaccagtacgtcgacattccggccgggatgaacttgatcgacttcttgcacaccgcctttgccgacttgtacgccatcaacgaccagatgaaccaactctaccaagactacgccacgaaaatggacgaccggctcttgacccgggccgggcgcttgcaagaagaactcgacgcccataatttctacgggctggagaccgaaatcgagcgggtgatggccgggttgggcttaaacgaactgggcaaggagcacgtggttgccgagatgtccggggggcagcgctctaagattattttggccaagatgctcttggaaaacccggacgtgatccttctggacgaaccgaccaactacttagataccgcccacattgagtggttgatcgagtacttaaacgacttcgccggggcggcgatgatcatttcccacgactacgacttcttggaacgggtcaccaacacgatcgtcgacgtctcctttggcaagattaccaagtaccggggtagctttaagcaggcgatgcgccaaaaagaggagaaaaaggccctccaggagcgcgagtacgaaaaacaacaggaggtcatcgataaggccgaacacttcatcaggaagaacaaggccggttccaagtcgacgatggccaagtcgcgtgaaaagatgctggcccggatgacccggatcgacccgccggaggataacttgaaggcctcctttaacttcccttacgaaaacactggctcggccaacgccttgcgggtcgaaaacatccaggctggttacggcaagccactcttggcgccggttaccttttcgatgaccgggggcgaaaagctgctcttctccggctttaacggggtcggtaagtcaaccttgattaagacgattttgggtaagatcccggcgctatcagggaccagtaccttctccccgtcggcgaagattagctactttgaccaggacctgatttgggatgacccaaccaagacgcccctacaaacgatccaagaccagttcccgaccatgttacccaagacgattcgccagcgcttagccaaggccggcatcaacgccgccaacgcccaaaagccaatgaacctcttgtccgggggggaacagaccaaggtcaaactggccctcttggagctgacgcccagcaacttcttgatcctagacgagccgaccaaccacctcgacgacgaaaccaaggaggggctcaagcgggccctgcaaaatttcccgggcaatttaattttggtttcccacgagcagtcctttaccaacggctggctggataaggtcttaaacgtcgaaaaattaagccttaaaaaataggggtgcgcactgttaaacaggaatttaaccgccaaggaaccagccacgccaatccttggtataatggccttatacaaggggggaccacgatgactgaacgaattaagattttttcccacaacgacttggatggctttggggcgccgtacctgctccaagccgtccaggagaccgtttttccggacacgacttttgacattgataacatcggtgccggccggatcgacgagtactttgaccactggttgcacagcccggaagccggtagcttcaccgatgtgtacatcatggacatgacgccggactccgagcacactttccaggaactaaacgccaacttcgccaatcactggctggtgtttgaccaccacgaaagcgaggccgaggcccgccagaagcacgccgctaacgtggtcacccaagcagatgcggacgttaacccgagcgcggctagcctcgcttgggactggttgaccacccagccgcggtttgaccagcttagtgctgaccggcgccgcgacttggcctacctgatcgagctgatccgggcctacgatacctgggactggcaaaacgacccgaacatgagccaggaggtccgggtggccgccgacgagttcgaccagctcttctggttctacccgctcagtcactcggccgagtttgtcgagcaggtctttgcccagggctgggagcagtaccgccagcaaaacgacctgctggtccagacgctgaatgaccgccgagaccactacttaaaggggcacttaaaggacctgatgatcgaagaaatcgccggtcacaagtgggggatcgtctacgctagcgactacaagtccgagattgcccaccggctgatggaggaaaacccggaggtcgacgcggcaatggtcgtcgcccctaccagcgtttccctgcggtctaacggcaaggtcgacgtagctcagtttgccgagcagtacttccgcggtggtggccacgccgatgccgcaggcggccgcttggacgttaacctgatccaagtcggagagcaagcggtgatcgacttcgtcaaggaaaagatcgccaaccaagcagaagaagccaaggaagaagaaaccaccctcgccgacagcctcgacccggagctggcggctaagatggcggcactgtttaagaagtgagtgtgaccaacctccttgacaggtcgtatgactaagctaggacgggggttagtgcggcacgcactgttctccgcccgtacttaggcactaggcctgtggttgggaacacgttatctgtgtaatagaagtcaaaatccccagttaaggagttcttccttagctggggatttatttttgcctaaaatatagcaccaacggccagccaatcaagagaatgatcatcccgacccagacacccgccagcctagcgcccaagaaatcggggccagaccagtctggtgggtggagaggttataaagccccacccccagtaagtaaagcaagctgggcaggccaaaggctttggcgagttttttaatcattggtgatcacaaccttggtgccttccttgatgttttcgtagaaccacttggcgtccggcacggataaacggacgcaaccgtgggaggcagcctttttaccgagttgttttgcttcagaaagtttgtaattaccggattcatcggttgggacggagtggaagagatactcaccgtggtttaaccaggaaacccagtaatgggccccttcaccactctgttgactgtaaaagtaagtcccccgctcagcctggatgtaataagtcccggttggcgtatcgtttttaccggtcccggttgagcaatacatcgtgtataagatcttgccgttatcgattaggtaaacccgctgtttcttcttggaaaccttgatccacaggtcggggtgggcgttgacgtccgggtaggcgaccgtttccgatgacttttgccagtcaattggtgtccgcatgaccgaactagtttctgatgtacttgaagagctggcttcgttggcggtatcgacccggtggttacccaagaggttggcaaacccgatcgccacgactaaggcgagggcaacggcgagcaggccgcgttttaatgaagaccgcattctgattctcctttgattttcactaatagctggattgtagcacactttcacgagcggtgaccaccttccaggtaatggtaaccaaagtttaaccaagtcgtaatcccgaccggtcgatcacttagttaacgaagtgacaatctgaacggtgatgagttcggtgttaaattaaatttttctcatcagatccgtgacgggggtcaagaaagggcagaggggaggccccgttaatcaggaatagcggtggggaacaaagtggttgatcacgaagaatattaaattattctaattttaattaataactaaatctagtacaatcacaaccacaacatcttgtgattggagtgcaatgaatggctaaagaaatcaatatcttgtatatctcgttgagtggcaacacccgagattttgtgcggcgcttaacggactactaccaagacctgggggtggtggtgaattcgattaacgtccgtgagaaaccggaccgccaaaaactgacggcgcccttcgtgacgattttgccggcctttttaaacggtggcaacggtcgcgataacggctacagcgagattttatcaccggcgctgggccactacctcgcctacgaaggcaactaccaccgctgttacgggatcatcggcagcggtaaccgtaactttaaccgccagttcgccctgacggctaagcagtacgccaagcggttcggttttccctacctgaccgactttgaactacggggcagcgacaacgacatcacccggatcggccaactgctactggaacggtcccaggcctttgaggaggaacaagcatgacggaagaacgaacggatccacaatcctatttttactacaacaatctagttaacatcccggaaaatggctcgattgccgtccattacgatcaggacgccttaaaggcctactttaaagaccacatcattccccaaacggttcgctttcaaagccccgcaaaacggcgggcgaagctggtcgctgacgactacttggacggggcggttctcgaccagtacccggcggaattcattgaccaattagaggcccgggtgcgcgcccaccacttccgctttaagagcttcatgggggcttacaagttttacgcccagtacgcgatgaagaccaacgacggtaagcgattcctggaagactataacgaccgggtggtggccaacgccctctacttggcccgcggcgaccaacagttagccaaggacctgaccgacgagttgattaatcagcgctaccagccggcgacgcccacctttttaaacgccggtaagaagcggcgcggccagatggtgtcgtgctttttgattgacgtccaggactcgatgctatcgattggtcgggcgctcaattcggctctccagctgtcccggattggtggcggcgttggcgtcaacttgtcgaacttgcgggcggctggtgacccgattaagaagatcgaaaacgcctcgtctggggtcctgccggtgatgaagttgttagaggacgccttttcttattccaaccagctggggcaacgtaacggcgccggggtggtttatttaaacgtctttcaccctgacatcatggcctttttggagaccaaaaaggaaaatgccgacgaaaagatccgggtcaagaccctctccttgggcctggtggtgccagacaagtactaccagttgctcaagtccaacgccccaatgtatttatttagcccctacgacgtcgagcgggaactcaagacccccttttcctacgttgatttgaccaaggagtacgaccgcctggtggccaacccgcggatcaagaagacggcgatttcagcccgcgagctggagcaaaagatttcccgcctccaacaggaatcgggctacccctacatcttaaacatcgatcacgccaatcgggacaacccggtcgccggtaagatcatcatgtccaacctctgcagcgagatcctccagccccaggaaccgtcgactttgacgtccgacctgtcttacgaaacggtcggcaccgatatttcctgcaacctgggctcgaccaacatcgataacatgctgcaggccccggactttggccgtgccgttgaagtggcggtgcgggcgctgaccaacgtcactgacaccaccaacattgaggaggtccctagcattgctaagggcaaccgcctctaccacacgatcggcctgggggcgatgggcctccacaccgccctggcccgccggcagattgagtacggctccccggaggcactcgagtttaccgaggcctacttcttagccctaaattactactcgcttctggccagccaccagattgctaaggaacggggcgagaccttcgcgggttttaaagactcgcgttacgccgatggttcttactttgacgactacgtgactaagcccttcacccttaagtttgaaaagaaccgggctgctttttcaggcgttcacctgccgacgacggccgactggcaagccttaaaagaagcggtgcaaacggatggtttgtaccaccgtaaccggctggcggtggcgccgaatggctcgatttcttacgttaacgaaacttcagcctcgctgacgccgatcacccaactggtggaacagcgccaggaaaacaaggtcggggcactcttttatcccgccccgtacctttccaacgagactttgccttattacacgccggcttacgacctcgaccagcgcaagatcattgacacctacgccgtggcccaaaaacacgtcgaccaggggatgagcctaaccctgtttatgcgctcgaccttgccgaccggcctgtacgagtggaaaaagcctgaccaacccaagatgacgacgcgcgacctaaaccggctgcgtaactatgcctggaccaaggggatcaagtcgctgtactacattcggacctttaccaccgacgacgaaattcacaccgccaacgagtgtgaatcctgcatgatttaaggaggaagcaatggattacttgtactacaaggcaattaactgggacgaacaagaagaccaggtcgaccaagccacctggttaaagttaaccaataacttctggttggacacccgggtgccgattaccgacgatcaacctagctggcacgccctgacggcgcagcaacaagcccaagtggggcacgccctagccggccgggccctcttgagcgccttccagtccgaactgggggcgccgagcctacgggcgggacggcggacccaacaagaagaggcggtcttaaacttgatcaccttcatggagtcggtccacaccaaggcggtgacgacgatcttccgccgcttgaccgatgaagaaaccaccgctgcttattacgcttgggctgacggtcaggcacctcttcaagcggcgctgatcgacttaacgaagggaattgaaggagacgacctaatgcgccgcggcctctttttgatcgccgacacggtcctgtgtgccggttttgactgggcggtcctgacccagccggccctggcccaaactaaccaaatgctgaaaaatattttgaccgggaacctgatctttcgtgattacctggcttacaaattccgccaggggatagctgagctgccctttgcgaaacaagaggccctggtagcgcaactaacgaagggtgcccaatcgttaatcaagctcgcccaccagcaaaacgaggtcttgttagaagacgccggggcggctaatgacttggttgacttccagtggcggatgctcttagtggcccttggcctgggtgaacaaccagccgaaagtggcccggtagcccaccaaatcgatcaactggcaaatcaagctcaggaaacggtggtggttgaaacgatcaaagacgccgacgccaccgagttcatgagcgatgacgattacgatttttaggaggagacaatggcttatacaagcgtaaattggaacgtcgaagaagacgaatttgacgaatacgtctgggacaaggcaaccgcccagttctggctggacacccgggtgccggtttcaaacgaccgcggcgattggcgaaccctaaccgacagtgaaaagggggtcatcaataaggtcgtcgggggcttggccttgcttgataccctgcagtcagaagagggggtcaacgtgatgcgagaggacgcccggacccgcaaggaagttggcgtgatcaacgatttcttgatgatggaatcgatccacgccaagagttacgggacgatcctgagcactttaaacgatcaaaagacgattgacgatacctttcactggatgaataatgatccgcggatgcaatacaaggttcggcgcattaacgagatttaccaaaatggcaataacctagaaaaaaaggtcgcttcggtctttttggaggggatcttgtattattccaacttcttcaccccgctgtggtaccggggtaacaacaagttggccaacctttcagaggtcatcaagttggtgatcagagacgaatcggtccacggtacctacctgggttacaagttccaacaggcctttgccgaactgaccccggatgagcaaacccgcttccgggcctggatggatgacctcttagctgacctgttggaaaacgagttcgcctttaccgaggtcgtttacgctcccattcagatggtcgaggatgtcaaacagttcgtccgctacaacgccaataaggcgatgaacaacatgggctttgccgccatctttaaccacgccgccattgaagacattaacccgatcgtgatgaacgggatctcgacggagacggccaaccatgacttcttctcccaggttggggccggctacttgatgggcaacgccgaggcgatgtccgatgaggattatgatttttaggaagtgtgacccaaccgataaacaaaaaaagcaccccacggggtgctttttttgttactggggttgagaaatccttcccaatccctaatttgatttttgcctattccacagataacgtgctcccaaccacaggcctagtacctaagtctggccgcagaacatcgctgacgcgctaacctacgtcctatccttagtcatacaagcctgtcgaggaggttgggtcgtacttcttatttacttaaccggtagtctgcctgatcggtaccacccggttcgtaggcccgcatccccatcgccgcccggtagagggcccgttcaaaggactggacggaaaatgaggaggtattggtaaacggcaggtcgtacttcttggcaatctcggcggccgaccaggaggtggcgtgcttgctgtaggcggcgatcatcacaatcaggtcgacgcccttaagttggcgttccatcaggcgctttttgggaataaagctatccacaatccgtggcttaccgttgtaacgcttgacgatccgttcaaagaggacttggttttgcccgcgccccacgatgatggcgacctttttccccttcaggtccaggtcgtaagtcggcttggccgctggtttgggcttggcaacttgttttggcgccggttttgcctgccggatttgactggcgatcgttggcttggcactagcttcgaccgggtagtgccaacggatgtggggttcaaaggggttaacgtcggcgggttgccccgtgtaccaggctagatcaacgatggagccttcgttgatctccatccgttcgatactaagcgtttccacttggtaactcgtctgttggccattgatgacgaggggagcgccgctaacgttttggcgaacgaccagttggcccggacccagcttttcgaccttcccgtacccgaaggtggcaatggtagaagccggcacgtccttagcgtgccccactaccttcttgattattagggtgccgtcgcggtggccgggtgtggcgaccacttcgtcaccgtgttgaatgccaaactggcggacaagcggttcggtgatgtgttcgatatcttggtgatcggcgtccatcagcatggccccattcagttgccgccgtacgaggtagtggtgggcctttaagcgtggtcgcttagccgcctggcgttcctctttggcgactgaagcggcaaacagttccgcaaagctgggttctgccggggcggacttggcggccggtgaaggagtcgctggcgccgttgaggcaggcttggctggcgctgggcttaccggcgcctcgttaactgcggggttgtccgttttagcaggggtggcttccttaacttccggcgcgtctgttggctccgccgttggtgcctgctccttgaccaagttggtgatggcgccgtgcaggctggcggtcacctttttgagccgctttaaatggctcttggccaggcctagttcgccggccagggcttcctggtcttctttgctcaggtcgtcaattagggcggtgagccgtttttccaccggagcaaagtccaccgtggccaggggatctttgaccagctggtttaggcagccgtcaaaatccaggatcaggtttttgatggtttggtgggcgctgaactgttcgccactgtatttgactggttcaaggtcgtcttgacccgtgggttggtttaacgatggggctggggtggcctctggttccggcgtcacggtaactggttccggcgccgcttctggctggtcctcctcaactggggtaacgttagcctccggtggcgtggcgaccgtttctgttgccggagcactagcgtctgcggtagttttcgtgggtgtttgttcaatcaggttcgccagcgcgcgcaaggcggctggtccgttggttagctcgggggcttggctcccaaagctgttcaggacggtttgtaagtcctggcggtaatcgtacattttaaatcctcccgtggtttgattaaccggcgtatatccccaatgcacggctaatcaaacgaaaaattaatcaatagtttcgtaccttctatcttaccggactttgggggtgatgaaaagggaagtgctccccaacctagtgaaaacaaaaaggctgggagcaggtaacggctctcaacctttttgaatgttacagagataacgtgctccccaaccgcaggcctagtggctaagtctggccggagaacgacgccagggcgtcaacccccgtcctatccttagcccacggcctgctttacggttgggtcgcacttctttttataaatccaacaactgttcaggggaagtcagcatgaagtcggcgtcggccagcttatccttatcgccggagccgtacaaagcggcggcaaacttgatcccggcggcgtgggcggctagcaggtcgttaaccgtgtcaccgacgtaaacggcttcgcttaagtcggtgttacccaggcgctttaaggcaacttggatcatgtccggggccggcttaccgtgtttgacgtcatcaaaggtgaccgccgtcttgaagttcttggcaaaggcaaacttagcggcgatgtgttcttggtattcggcgcctaacttagaagtcgccacggctagggacgttcccggccggttggctaacttggccagcgtgtcttctacgcccgggaagatcgtcgtccggtcctcgcgttcgtaagagagcttgaaccagtcggctaaaattgcctcgtgctggtcttccgggatctgggagatgaccagggcgtccttaccggtgattccaaagaggtcgtgcttcatgcgttcggcctcttctggcgagtaggtgtaaccgtacttggccaagacgtcaatcatggccggcatgtacatttcgtaggtgttgatcagggtgccgtcaacgtcgaagatgaagtttttcattgctgttcccccaaatggtgtttacttgttaaatgtgcccgcttcgacctggcgaatgaagtcggccaggtgcttgtagtagacatccgggttgtcgatcatgtggtggtggccaccgtttggcgtggtgaccagcttggagtttggaatcaggctggccatcgtttcggccgtttgcagtggcatcgtttcgtgttccccaaaggttaacagggttggcacggtgatctttggtaattggtcgcggaagtgccagtccttgagcttaccggtaatgacgaattcgttgtccccttggaaggcgttataaacggcggtaccgcccaaatccttgacgtggtacaggcgggacggttgcttacggtcaacgaagttttcgtttaagacctggacgtcttgttggtagcggtcgttgtcgtagtcgttgttttcttcgcacttcttcatgaagacgacttcttcggccggcaggacttcttcgcggcattggttaacgtgggcaacgtattcgtcgatttcgtcaaccatggaggagatgatggctcccttcaagtggtcgccgtacttaaccgcgtactcttggactaagagcccaccccagctttggccgatcaagtagaagttgtcgatgcctagcttttggcggacttcttcgacttcatccaagaagtattcgtaggtcaagtacttgtcggcgatcgccgggttttggtagtccggttggtcggagtacagggagcccagttggtcgtacatgtggacctggacgtttaagccctgcttttgcagttgggccgccgtgtcttcccagtattcgtggttaccaccggggccaccgtgcagggccaagaggtggatggtaccttccccttgggtgttggtccacaggtggtagccgttatcaagcgtcaaaatcgttgtgccttgtttcaaaattttcaactcccattctctttgcgtcatcaactaacggtttccattgtaccgcaaattacaccaacgatagccggcatgtccacgttgttaatcagccggatatgccagtgcttatcgtctgcgatatacggttgccaagtctggccatctttaccgttggaaccgtctttgccaggcgcgccattagcacctttcagcgacgcaagccattgtgcctgtgtgccgctgtagccattggctgtggcaacttcatatgcagacttgccgttagctccggcatcccctttgtcgcctttctcgcctttaatcgtgatgatttttggcttgatcagcgtccacatgttgtccccgtctttgttgttaaacaaaaactggccgtctggcgacagcttgggaattttgttttgaccgtctgggctggcaaccagcatctccccaccttgtagctcggtggtactgtggtcaaacccaacaaaagcgccaggtttgatcgtgtagttgccgttcgggtcggttggctcaacaatcgttctgtccggctctttgaccagcttgccggcaatgtcaacgtccttgtccagtgcactcgcgtagctacccagaccggtcttgctgtcatactgccacatgtcggcattgcttggctgattactgccccacgccgcaatccagcggtacacgccctgcttaacaagcgtggcgtcgtcaaactttgcgtagttgcttagcgagcagtacaggccagtgttccaaccatagcctgcccaagctttgcggtacgactcaaagatgcttggccatgagccggcgatcgtgccttccatgtccaggaagtagtacacgttcggctgaacgttaaggctcttggcattgttgaccgagtactgtagctcgccgtccacgccttcgtagtagtgatagacatggacaataagcccggctttcgtcgcattggcgatatggtctgctgcgtgctcatcacgcatcacaccatgaccgatacgcacgactactgctttgacgccgttagctttcaggttggcccagtcgatactggttggctgccactccgatacgtcaactacgtttgctgctgtcaaatgccttcacctccgtttcgttccaagcgctatttgaatcatccctgttattactgctaatgatcagtgatttagtctgttcctgcagtctggatagattagtctgctgcgaccgctgaaagtcaagaatgttagcagcattgctgttaagcatcaccgtagacgactgagtatgactgtatggatatttctgatagccaaccaagccaactttggtgacatagtcagccggccgaatctccaaccgcaccatgtcgccttcgacaatctctttaccggggtcaaccgtaagctgcagcgtaaagtctggattggctttgaattgcgactcagcataagctttcatctgttccttgtcagcgatggtgtcattggtgatgtcatccccaacgaacaatccccagcgctgatggctggtctcatcgacaaaataaaaaggagcaaagtagtactgctccttagaatcggttgtagatgccgttccatcatcatcaccgccggatgaactaccggcaacaattttggccatatcatcgttacgctcccaccatgtcggcgggtagtagctgattggttccgtcttgcacacctcgccaggctgtggctcatagatcatcgtgctgttatccaaagccatacagatgtgatggctggcattttttgatccgtagaaacccatgtcgccggtctgtacctgatcacggctgatctcatgtccataggattccattgatacagtataagccgggatgttgatcccgaaatcgtagtagactctgctgacaaagctcgagcagtccatcccgttgtacggattggcagtaccaaccggtcgtccaccgccatatacatacgggacaccgagatacttcttcgcgtcggcgataacgctttgagcgccaccactggcagtcagcgatccgttaggcaacccggtatcactggtggtctgaatttcctgtgttgcgccaaccagacgggcagcgtttgtcatatcggttgtgtcatactgcaactggacttctggcgtgtcgcgcagatagtcatagcggtgaccatagtctttgtagaactcgtcatgcgagtagatacgcagattaagattgtccggccaaaagaccgctgaagaccatgcctccagaatccggctgatagcgtctttaccggaaccggatgcatatgggctttcgaccattgtgttgttaaagctgccgattacttgataggtgatgttccagttcttacccttatcaccgccaaaaaaagcattaaggatatcacctggagacaccgactgagcgaccgtgtcagcgttatccggtacgtccagggatacatcgctgttgccagtatgcgagtactggccccaatcaaccggatcgctaccgtagaagtgcattcggctgatttcgccggagatatgctgcagagtaacagctgtcgtaccaataccgccagagtagtccggctcgcactgtttgatgacaaaccactgcccatcaatctcgaccatgttctgcacggtcagcatttgataggcggcggactcgtcatcccaagccgtaaagtacgcttggtaagtgttgttgacttcccaactgatatagatgctgtcttccagtgccgagtggagcatggcgatctgatcatcaccatcaggcaccttcagagcatgatccttagtagcagctacctttaagactacgctcatgacagataaacgaacggaaagctgaacgtgatgtccacactgccggctccttcggcagtaaagctgttccatccgggatccagtgagattgtgccatagtcagtgttgacgttggcaagattgccatcaagataggtgtcaattccgtcgagtacgaccgtatggctgccgtcgttagactgtgtgtactgccagctggtgccgttggtctcgttggtaagcttaatggagttgccgttaaacttgcatgagatcttaagatcgtgacgctgatagtacgggtcgaccacaatatcactggcgttgtagacgttaaagcttgtcgaagtaaaatgatagcttggcaaagaatcgggcagattcataccgaactgccaaccgtcagccacgcttggcaaagaatcactccgatatagcgagtagcgataaccgtttggcacatcaaacggaatcgaaaagttggcgttgttagaccctggggtaatcggtgcaatatcaaatggtgtcgggataccaaaatataccttacaaggactggtatcagtccgtacccgaaccaacttgcgtgagccaaacaatcgataaagctcatgcttagccaataccagatcatcatatccgccaaaactgagccagaatttctcactaaatgttcttttggcgaaagtctggccggcaaatggtgagccatcggtaccagtcgtatcttggtactgattggtaaattgcggcgacgagctggcgtcgtccaatccgagataacgcagtccggttatctgatcacagagattaacttcctgctgatcgccaaccttgatcatgatatatggatccggcatctgctcatctccttcctagaatcctaattgacgcattctcgcgtcttttgcttcctttttgtacagttgttgcatgtcgagactaccttgtgctttaatcgcgtctacctgatcgccgctcagacgcagcaaaatatcaaacttggacagtaactcgtctaacttgtggatcagagcgtctgattggcgatcatttccgtcaacatattgagcattatggctcagagtaggatcatcgttgcggaatctggcaacgatctcgccaagtagctgatatgcacgtgaccgtctgctgatgtcggtcgggatgacatattctggcatgttcttttctgcaatttcataaacaccatggttagagatcagaccaccattagcccagccgtgaccattaccgacgttgccccagccgccttcgccgccgtgctccaagacgtggattgcggctaagatttcatcgtagccatttctccaatcagtatgccctggtaaagcatcagttcgccaagttgaaccggcaaattgcagaaggccacgtgcctcatttccgccagagtttctgtctgtatagccatgttggaaagctagcgggttcccacgggattccgtttggatctggcggagcagtttagccaccttccaatcggcaggggcaactcctaattctttgaaggctttgatgatgtaaggccgccaacgttcaaccccggcaccgcctgggttggcaagcgtctcaaactgtttcttgatccagttacccatctgtttagtgatataaaccggcacgtccttaaccaactctgcagcgaacttaaccggcgtgctgacatggacaaatttttggaatacggattccataaactcgaccggctttgacatgattttgtcgaccatgcctaaaacatcatcagttgcatccccgactttactgagtagcgagctgaaagcattgcccacaccgtctgcataatgcggaatcgtcccgagcatacgcgacagctgatagctccgttcaccatcaagcacactggtacccttcggcaatggcagaatcaagttgcgattagccgggaacatcccaacttgaccatctttggtcataaacatctcacggtagtgtgccgtcaagccgtcattgactctggcaaagccaccgggatgagtgtcgttggtaccgttggcgtagcttggcatcgaaatgctgaaatttccaccaatcttagatccaccgactttatcaaggacccagttgataccgcctttgacgtcatcgatcatggtcttaaatggtttaagtacaccatttaccaaatcaacgaaatgacgatgcacactgccaattgcattgccaaccgcatctcggatcttgccaaaaatgtcctgccaaatcttgagcatgtcgcctaaacgaccgcccgtcatgtcattcagcttgttgtacatatcggaaaagatcttgcggttgaacttaaatatgtcctgtgcagtgtttttagtgtcctcgcctaagcgatcccagcgccccgaaacaaagtcgtgccaagtagtagtctgatcctgaataaccttatagccagcttggaacgtagacttatgcttgttaaacatctgctgagccgaacggacagtattactactcagctcatcccaaccacgctttacattgtctgctccttcaccggtctttttcttcaggtctttccagccatcggcgaaactctttttagttgagttccaccagttgccgatttctttgttagtctccttggttcgttttgaaataagcgtgccaaggcctttaaaggctttgccaaaatctttagcgaacttgccaatctgtttgtggtacttaatgatcagtgcaagcgcgacttcgattgcaatcatccaagggttgaacccaagcgtggccaccttgagcacacgagcaaaaagcccaattcctttaatcagagcgttaaggccggacattgctttggtaaagacaaatgctaccgcaatagctttagcaaagccaactaccatcgccttatgcttggaacagtacacggcaaatttgacaactgccatcgcaagcttgccaaggtccttggctaggtcagcaaatgcctgcttggtagactttttactgaatgcttccgccaaagcaaccgaagctttagaaattgccggcagaagtgcttgaccaatctcgatctgaattgcttgcgatgcatacttgaaccggtcttgcgcgctcttagcggacttcatgttgcgccgagcaagcttgccgatatagtcctcgttgtacgcagccttgaccttgccttcgactgcatcaagatccttgaggttgctagataagataacagcggctgactgcgctgactgaccgaatgcctggttaaagactttcagccgatccgccttaggaaccttcttattgatctggtcaaagatttctggaatcgacttaagcttcccagacttagtcttgaaatcatcaatcgacaatccatactctttaaatgcattggtggcgctttgagaaccactggacagacgtacgataatccgttgcagacttgtaccggcttgagacgcttccaaaccattgttggacaactcacccagtgctgatgcagtatctctcatcgagataccagcacctttggccgtaccaccggcatactgcataccaataccaagcttggaaaagtcggtagacgtaacgtcagccgctttggccaaaacattagctgtataagacgtggcctgcatcatcttgttggcattgtcagacttcataccgaaagcttccagagtcgaggtcgtgacttccatcgtatcgttaaagtcatccccggaagccttagccgcctgcagcagttgtggcatggcacccaaagccatctgactatcatacccacgtttgatcagcgtctggtacccttcggcaatttgctgttgtgatatgccatacttgaccgacaagctggacccgtcggcatacatctgattgattgccttttggacatccttatgcttttcgccggcagtcgtcatcaggttggtgttagtgacatacgtatgctgtatgtcttcagccttcttggcaccgtcaaccgtatatgcagtaaatgcgctgacagcaattccggaagccataaccccgcttttaacagaatcccagaaactgtttacctggcctttgagccgttccagctttggctgaatctgctcagtatggtcgcgcatcttgatgatcgcactgtcaacgcgagcaattcctgtcggttcaagggatgcttcttccacacgcagctttttaagcttatcttttgttttagcaattgacgttgcggtttcgtctaaccgctgtttttgcttgagataagcgtcagaagtttcgccagaacggctcttaatttcctcaagcattctggactggatcttatactgcttctgcagattttcaagaccagaagccagttggtggtattgtgcgacggtttcagaagcggtgcgatgttcggccgccatacggtcaacgtaggctttcgacgccgaagcgttgagcttgtactttgactgcaagcctgacaagccagatgcttgcatatcataagctgctttagcacgctgagcttgagcttcataactggataattgacgattggcttgattgatctgtttttcgagtttcagccactggttggcctgtttctcgttagactgatcaaggccatcttgacgactacgcaactcttcaatcttggcacgttgcagttccattgcctgggtaaggccatcaagttttacctttgcagcctgcgtataatcgccactgttttttaaggctgtttcctgggctttccaggcattggtcgtggccgtgattgcgttccgaaaggcggacatgcttccaacagcagaaaccgtgtcaaccgaaattcgcgtggacatttcatcctgtactttcaagctatccacctccaaacatcttagataattgcgcgtgcgcgtcctctgggttcattggcctatcatcccttgaccgcgcatttaaagtttccaacagttccaaataattttgattgtccaagtcatctggcaaaacaccgctattgagcatcagctgctgtttaaggtaattgatgtcttctatttcttgtttgagttcccagattcttttgcggatttctccgcttccaattttggggattcatccgtagatttaagcgcttcttgtgtgtctttttcgctaacgccagacgtacgactacgcagataggacagataagccccgatttcttcttcagtggcattgtcccaaatacggtcttcgtcaatatgcagcaactgcgcgatgaatttgattgcaccatcgataaatttggattcttgatcgatggcttcagcaaattttacttgtgcatcctcatcgttaacagactcatcagtagccaaagaagcctccagcgcctgcttcatgaactggttaagcttgtacgttacccgtacggttggcttaaccgtgattgactgcttaatgccgaacagggatgcatctactttaattttttccattttgacacctcatattagccgccccattggtactgtgtatttattaggcgacctttaattttctagctgtgagtaacggtactgccagaagtagtagtggtttggacttgcttggtgatatcgtcaccggtatagccaccgaatacttccttaagcatagctgcagagctgtatccagttgcgccgctgttccactgcttgtagggttgttgcgtaccatttgagttaacaaagacagtgttgtcaattggcgtcaaagcttggtaggtaaatgcagcattggcgtcagtttcatttttgttgttggtaccgtgattacgagttggcataatcatttcaccattggcaaacccgtcaaagtacttgttgcccttgaaatcattagagcaaatcaacattgccaaatgtggctttttgcccagtgatgcaccaccagttgcatcaagttcataaccactgcacttcatgccaatttcataaggcaaatccagataagtaacagctacttgtggagttggcgtaccatgagcgatacgcttaaccttgttgttagcgtattcttgcgtgcctgcttcttcgatagcagtaatgtttgcggtcgtggcaccttcgccatcgccgtccagcaatactacgccggactcagagagcccctttgtagcgtcagcaataatttttccagtatcgtcaatcagtgccaacgcgatccaattgataccggaagtagaaatacctgcggacatttaattcccctccttgataatttcatcctttgcaaaataaaagaccttcgtcacttgcttagtgtcggggtcttttatgtgatttttcgattgttcgacagtccaattatcgtcaacaaacagccgtgctagtgcctgttcgccatctagtgcgctgatatcgttgtcgagcttgtagaatatctgaacttccacaccgaccgtccatcccttgaaagtatggttggcatagtaggtaggctcgttcagccattctgtaatcaaacagattgtcttgctttcataattagactcttcttctgggattgaatcagtataaatctcatcaatccagtcaaatttgccattgagcagatctagcacttgaaaaactggcaattccatcatttgacaccgccatttcttgcgtcaagcacctttttctctgctataaaaaccttgtcagccgaatcgcggcgcgcgttgtcaacaaagtgagtagccttcatcttaacggttccgtcattcaggaatctggcgatataggctttttggccaaagccgacaacggaattgccgtcatcttcaccgtcaatgtcggtattttgaaaaccaacattgtcttgcaggtggccatactttggatttttctttgtcgagcgtggggttgctttgcgcaactcgtctgctaaaacttcggctccagcagcagtcattgctttcctcgtatcatgatcaggaatggcaaatttttcggtgttcttgccaaacacctctaacattttaccgagatcatccattggtagcaccagctttcttagtatccttaagcgtcagcagatcataacgcgtagtcgtatggctctcatccctggatatggccaagatgtcataaatcgtactgtcgcccttgaatctcaccttgagctgtttgtcaacatgatactgagagcggacagctactaccgttgtatctgctaatgtcgtcccaaccaaagcatactgctgtgattgagaccgctgatagattgcacagtgcagagtttgagtcggcacaaaattttgacgtgaaccgcctaatgccctgctcggaacggttgataccgtaccgagttcaattatgtggttcagacggctgattggtagtttcattttggctcgcctcccaaacgtcatatcgtccacgtaactgaccaataatgctattgacggtcaggtcaatctcgtatatctggatatctgacatgctcaggcggtattgataataggtagctgcaagcgactttactgccatatcaaacaatggcgagacgttgctttgcgtgtagaacgcgtcaccgtcaccaattgcgcccttaacgtactgttcggctgcatcaatgtaagcctgcagcagtacgtcatcgtccgtgccgtcaaggtatagtaccttttttacatcgtctactaatacagccatttaaatcgcctacttaccagcgcctgcggaagcttggaagttagccgtctgatcagcaaccgttgtaaacgaaccaactgcgtatgcgtcaccatcgacttgttcaacgtcaaaccggtcaatgacacggatcttggtttcgtcatgttcaaaagcaccagcaccaacgttggtcgtcatcaggctcatgttttcacggtcaaacagtgtgatagcctgcttaaagtcgccgtagtacagtggatgagcattggatacgtctggtagccagcggtcagcaactaccgtgaccggcttgccaccaataaggtagatttctgggctggttgggtcgcgttgtactaggtagttccccattgcgttcttaaccttggccagaacagcaaagccagattggttggtcaaaaacgatgacgtagcgttgattgcggggtcaagtgcggtcagttccagatccttgatgtcatcaaacttagcaattgttggcttcttggatgccgtattcataactgccagaatagcttggttacgagtaacgacaaccttgcgggcgatccaagtagacagccatgcaagaatgttttcagccgtgtccttcagcagcgtgttagtaacggtcgtgataccagcgtaacgcttgatcaggtacttgatcgtagtcagttctggatcgtcgttgtcaccaattgcagccgtttcatcatccagcgatgctaatggcttgatgtcggagaacttttcgtaaacccgcgaaccagattcggttgttacggattccacacgaatcaagttctgcagagatgcatattggcgtaccagagtattgatagtcgtttggatgtcgtctgggatcgtcagaccaccgtcgccagtgccagacgttcccgtagtaaccatatccttaaagtccttaacaaacttgtctttcagcgacagctggctgtcattcagcggttccttgtcgccgtcatgcatcttaactacttctgctgcacgagcttcattaagttggtctttcagagcattgcgacgttccttggcatggtcgcgttgttccttcaaatctgcaaaagctgcttgatcaaaagagtcgtccatcagagcgacgttaagtttttcgttcagatcagaaaccttttggccggcttcaatccaagcgttgttcagttcattgattcccatgttgggcctccttcttgtctaataaaatagccagcttatcgtcataaacagacggagccggcttttcttctggctttggctgttcagccttggccataagcgtcatgaatttgttgattgctgcgtgtgaagggatactgtggacagcattgaccacttgtggctgattttcatcagcaaacatgattttgtcggcaaagcccttatcaactgcatctttagccgtcatccaagtttcgtcagacatcagcttttcgatttcatcccgctttaagccggttttggcttcgtaagcgttgataatcgtttggtcaacggtatccatcatcttggaatcatggtcgagatcatcggcgtttccttgcgttacggtccatgccttatggatcatcatctgcgcggttggcgacatgttgatctcattcccagccattgcgataaccgatgcagcactagcagctagaccaagcacgttaaccgtaactttgcctggatagtcgcgcagcatcgtatagatttcagacgcagcatgcacatccccacccggcgatgcaatgtccaccaccagatcatcatcggcatcggctaacgttcgttcaaccgcctgaggataggcagaatccagatcaaaccagctgtaaaatttgccagtcatgttgtcgacaacgtcacctttaatgttaatcttggtcatcattctcacctcccttctctgcattatcagcttgcggaagtttttccggtaaatacccggattgttcaagcacgtaagcagcctgattgcctgccagagtccccgatttaaccatcgatgaaatcgtgccggcaaacgtatcgccaagtggatcaacggccggtcgcaggtccagtttgacattgccagtcagcttgttgctaagttcgctgtcaatcgctttggcaaaacggctcagcgacttggcatagtcattgcccatcatggccaacgatgactgttggtcaccttgaccattgattaccgagtcagatacaccgtataccttggcaatctgtgcgccggtccagttggcttgattcagcagttgggcaacgttgccttggatttccaaaggctgatagtcttccaaatcgtcaagcacgattggcccactccccgacgcctgcatttgctgcataaatttctgcgagcgttgagccctttccttagcgttgagcaacccgcctttctggacctttaaaatcccaggtgcggaaatagactgcgcaagtgctgagagagtcagtcgattacttgccttgctgatactcagctcattagccaaagctgacagcgggccgataccagtcttaccgccattttgggacaaaagccgaatgtggatcatgtcagactgtggtatggcctcaacaacgccaacgcttggctcatcaaacgtaaccgtatagatcagcccggtgccgtcttccaacaaatatggcgaaacctgagatggtcttagatattcccaataactatcaatgccgttgctattgcgccaacggtaggcaaaacactcaccgccaagcagtaattgagcaaacattgactgccagaaagcatgcgcgttactggtgacggtaggattgtcaagcatcccttgtgtccgcgacttttcagcaacaaaccgaccatttgccaaatccgagctcagctgaaagatcagcgagtagacgtcagagttatgcagagcagttgatgcatccacataatcgctagtgccgtttggattgaggaaattgataatgctttgatcatccgcgattgataaaacagagttagctttatttctcagtttaaaaatcggcattcaatcacctcctttcagctcgcaatcatctcggtaatcagtccaaccacaatcaatgcaatgccgaccgcaaaaatgccggccgtaatgcttagtctaaaaaagccccagacgataaataaagctgcggctaaaaaacataaaacatcaatatatttccaaataaatttcagcataggccacctccattacagcaagccagagtcttcgttttcaaaccaagctttgacttgctcaccggtcatcagttcgacctgctttgatttatcgttggcaatcccaaagtcctcaaagtgatacatagcttgatagagagcgtcaataatcgcgtccacaacgtcgattttcagcgttgctttggccttgtcgacctggatgccaatcttatcctggataatttcggcattaacaagtgcttttcccatgatttcatcatcatcccgcgtgattgacgactcaacgaagcccttctgcaggaacttagtcggatctttcagctcactggtacgctgtcgaactgggttcaacggccattcagtattgatttccatctgtttgattgcattggttgctccccacgcatcgtagccaaaaaaaaggaccttgagatcattgtcggccacaaaatcaagcaaccattgatagacctggtcgtcattaatcaaaccttgtggatggctggtgattgtacagtagccttttcttgctagttcccgatactcaatcccgtcttgcttttccttggcctcgattgagccggctttttgccatggaataaagctatgctgtttgacatgccatttctggttgccgtcagcgtcggtgtatgggaatacaaaggcaattgcagtattgtctgaaaacatagagtagtcaaagccgatataggcttgctggccacgaaagctaaaatcatctttaaccgctcgctcaatgtcagccagttttagaaatgagttagtagcttcctgcagccacatatttaggttcttattctggaaacggtcgatatggccggccatcgcctcgttgtttcggctattggtcaaacccttgagcagcacttctttttgactgtccaagtaaagcagcgggttcgacttgtaccatgtttcaggtttaaaagtttcatcaaggctgtcttgacaccagattagtcctagataattatcgccatcacgtttatagtcctgttccataatcgttcgagccagtttctcgtcagcatgatatggcactgtcgggtctggataggccgttgagatctcaatgtactgatgattaggcaccttaacttgaccggaagtgatctttgctgagccttcatcggtgtgaatattgccgatttcgtcaaataccgccgttttgaagtgatacgagtcgtactttcccgaattaaacgtgattggccggataacgttgttgactttgcgcatcgtaatcttgttgtgcagtacggccaactcaacttccttggcaagcttgccaaaaacaggctgctgctcggtaattctagggatcatgctgctgatatagccaaaaagcttgccggtctggtctgcattttcggcagtaacaaggtagtcctggttggatagccccattgactcaatcagatacgtatagcacatgtagatagccatgagataggtcttaccttgaccacgtgccaccgaaagtatgcagcgatcaaaccgttttaaattcgactcatcccgccagccaaatagcatacaaaagatgaacttctgccagtccattagtggaacaggcacgccggtatcaacgttcggggcaatcgatgcgaatttaagaatcttatggcattctttagtgctgtagtgatagtgaaaatcagcatcccccacacgttgcaggtctcgcagatgcctaaaagcggctagtttgatcagatagccagtcaaaatcttttcctcaagtacgtcaaaggcgtactgtgtgccaggatcttgatactgtttgcggatatcatcaaagttgatgctgtgataagccccaagcacgtcatgtgtttgtgtcaaatcaatcttcaactataccaaccccgcttctttcatctgatcgctgattgacttctctttcttctggctcgcaatctgcataaggtcctgtctgcccttaggcgttaggccgagctgaatgccaatcgagttaagctgcttgtttgcatcggtcatgattccaacggccggattctttcggtatccagtaaaatccttgccgataatctcgccggctgcgttctgcaatgacgtaaatagcttggtttggatgccgttttcctgcacgtcatcatacgcctgacggtagatttcgtactgagtgcagtactgttcgaccatgccagcatcaattcgctgaacacgctcggtactttccagataaggtactatctttcgccagcaagcagcagcaatcggtccgaaataattaggcggattaggtggcaaacggccgtgattttgcttaaaaaacacctgttttggcacttttggctctcctttctgcagattcggaacgttccggagcccccctggggtaaaaatttttaaaattgcatttttgtaagagacgtctgaaatgtgtgcgctctttttggcaagcaattaggggggcgggggtaaattttaaaattggattcgataaatcccatcaaaaaaatttaaaacacgcgagagagcaaatatgagcctctcacagcgtcataagcttggctataacatccacgtcatggactagctcagcaccagctatcaactggttgtctttgccagtgccatagtgctgttgttcccaagctgtcttgagtctatggcagtcccgacagatggttaccaggttgtcagtgtctgcctgcagcttgctgtcaaactcgattggtatgacgtggtcaacggtcttggagtttggcttgccacagtactgacagacatagtgatcacgctcgagtgcttgcttgcgcagtgactgccactgcctggatttgtagaagtggtactgcgctgacttggtatcgtcacgatatcttgtgacgttgttgtaattgcgttggtactcggtgctgtgcgatcgtgcccacttctgacggctggctagatactcagcctcatgctcatagtgctgcttgcagtagtgatcaggcagctggcacatggcatgacatcccggatatctacatcgtctaacccttggcgttgtggccacctcctttccttgtacgcaaaaacggtggcttgatcgtgtgttctgccggtttgtctttaactcgttctggatgctgcttgcgatagatcttgtcagcaagcacaagtagcttatgttcttcgtatgagtagatgccccaatccttgtacgttctcacgttgtcaccgccttacccaaaacaaaaagccagccgttaagctgacttaattttctcagttattgctatcattgtcataagcaatagatggatattcataatttagtttcaaaatcatttcgcaaaacttaatgatcctttttgcttcttcttttgtgttaattcttatctcgtggtttgcttggttaccaaactgtctaatttgatcaacccattcgtcacttcgtgcaccggcataatgatgttcattcaagtagcctacatactgaataaatctaaggccagagtctgcacctaagtcagtagcaatatgcattagcaactttctgcaaagaagcactacaccagtataagcaccagcagcgaaagaactacgtgcttcctcatacacactgcttacctcttctggaacattattcaccggttccccatacctattacctggaacttgaatatccttatagataaatgtcggcatatggcaatgggtacaaatgtatacaccatatggttttataccttgaagtgccatacccctattactagaaacctcatgaccacaatatccgcatatatacgatgcttccacggtttcaccattcttccaagaatttgttacattatcttcatataaatctttaaccatcttattttcacctcatccatataatacaaaagcccggtcataataaccaggctgaggtaaaaataaaatgatatgtagtttaacgtcattgcggacaatgacggcctgtggagttgaaccatagcatccccacatgaagtataggggtgaccataccgtctgcctttctatgcctaagccgaaaggaaaaagagttgattgcgctactctcaacgcagatacccggaatcgaaccgagatcagaagctctgccattgagctatatctgctgccaacatgtgattgatatgcaatcataccaaccaatttaagaggtaaagagtagtgagcaatgtggccatgaatacttattttccccacttgtctcactatagcaattattgcacagatctatcccggcggcttccgggttttttccgcattttttccggttttttgaattacttccacacttgaatcggcggaatcagatcttcgcaccctctgatcgccacaaacttatctagggccgcggcgaatcgagtccgtgctgtgatgtccgcctcttgatactggtcgttaccaccgattaagaccatctgcatgacggtctcacgttttgcgccgtttatgtaacgctcgttcagaatcgtttgctgtgctggcaagcacgacttaatcgcatcagtcacacaactaatcgccaaccggcaatgtgccttagcaatcatcgtttcttcaaaccgattgccatttgaaccatgaatccccgtgatgtcgccgaccggagatctcaccatcccgaacaccgcttcatcctctagtagttttggatatcctctgtaccgatagtgccctttgcctcttaagaagtctgctacgctctgagccgtttgatctggatctataacctcaaataatctcaccgttgccctcctcacatcaccagcgccaaaccggaattccaattagtccccagcaaatcaaattagcaatcaccaacgcagtgagtaacgctaagatccatttaaccgttcccatcattgtccttccgccctctttttacgtactgccgctttatgcagctcatttttcaccgttttaaacgaccgctttgaaatgcatgcagcatccgctaaagttagttttcttttaactttccattccaagagcatgtcccacaattctggaaactcgtttgtgcccttgtgagtgcccgcaagcttccgttccttagctaaaaagatcgtacgcaaaccgtcaatcataccttttcgtttagccatttccagctcttggagccgttctcgctcaagccggtcatctgacttacggagtttttcaatcgcccttaatcggcggttgaatttttgagtttctcgttcaaagtcaggttcaccaaattcgtcaatatatgccttatcttcaatttgtaaacggtcatcaaagcgcatgtgaattgcacaaagcaagccgcgtgtcagcaagttcacttctctacctcctccttaatttccaccgccaagtgcggccgttctgaatagaatttatccgcctgtaagcttagatttttcttctttccagcttaactaaggatgcactaagcttaagcggtcgcttaagcttagtgcatccttagttaagctggaaagaagaaaaatctaagcttacaggcggagaaattctattcagaacggccgcacttggtggtggaaattagggaggaggtagaaaagtggacttactgacacgtggcctgctttgtgcaatccatatgcgctttgatgatcgtttacaaattgaagataaggcatatattgaagaatttggcgaacctgactttgaacgagaaactcaaaaattcgaccgccgattaagggcgattgaaaagctccgtaagtcagatgaccagcttgagcgagaacggctccgagagctggaaatggctaaacgaaagggtgtgattgacggcttgcgtacgatctttttagccaaggaacggaagcttaaggacgctcgcaagggtacgagcgagtttccagaattgtgggacatgctcttggaatggaaaattaaaagaaaactaactttagcggatgctgcatgtatttcaaagcgatcgtttaagacggtgaaaaatgagttgcataaagcggcagtacgtaaaaagggggcggaaggacaatgatgaaaacgattaaatggatcttagcgttactcactgcgttggtgattgctaatttgatctgctggggactaattgggattccaatttggtgatggcgagtttgacaaaataaaaagcacccatgcagggcgctctcaaaacaaatatcaatccaattatacaacgaggagtgcacttcatgggactgtttccgcaaattgataaacaagcaacaattgacaaagtgcgtcatttcttttgggacgatgaccgatttgaagggatctgtttgagagcgggtaactatggcttgcgctcgccgcaattagatatcactggaatcaaaggcagctcggcctttaactcgactgatgatcggctggccgacattgccgactgcttacatgcgatttgcgccgttcacgaggccattcaaagttgtcggtattcgtccagagtcattctgaaggaacgttttttaccaggttttagagatcgtatgtacgttaaagaactggcgccgaagctagaacgatacagcgatgatggctataaggcactagaagagcgggcctgccttgatttcgcggatatcattgagccaaagtgtgcagtataccgtgttgatcgtcaattaattcctgattttcacgtctacttcaaatcggggatgaatcgggaatgaatcgggaatcgaacggagaccacacggggataaaagggcatatactggtattgtcaaaaagaataattaagttcccgttggattggcacttactctgggctcaactttgcctcttgcattaattattatttggatagttaggaaaaatacaaaataaaaagtcagcttaacggctggctttttattttggtaatgccactcaatcttacaaagcggctggttcgattccaagcaccgatatcagaaaggagatgacaaacatggcaaaggtacaccaatgcggtgaaatcagatgtcataggatcattccttttgatcaacgatactgtgacgtgcatgccaaactgcatgcacatgatgcctatcacaacgtgtcgcacaagcaacggctcgagtcgtacaagacatacaaccgtgagcatcgtgaccaagtagccaatgctttttatcacagccaagaatggcagcgtgtgcgtgcctacgtggtcaatcgtgacatgtatgcatcgggagtatcaggtatcacactgactgatcatgatctgatcgttgaccacgtggtaccaagacgcttgtgcaaggatccgttggatgtcaacaatctctggtgcctaagcagacgtgagcaccttgccaagacaaaaatggaaaagcatatcgctggcaaaccaaacggcgataacatgctgaaacatctaaatcgccaaaaatgggccgtatacattgatcgacagcttgcaagggaaaaacatcgaggcagtcgctaaaacgttcatagccccccccacaggcgctcagaaaagagcaatgtgcacattagccttccgttacggcaacgacagttataaaagttctcattatgggggctggctagattacaaaaagtaaggagatgacgcaatgccacgcaaaatgaaggtaaccagaagcccagacaacaaagcctatcaaaatcggcgcaccgagatggtcgaaaaggcgactgaagacctgcaaccgttgcagacgtcaccaccaaactacatgaagggcacgattgcgggccgagcctggcagagaatcacgccgattctgcgtcaaagcacaattatcaagaatgccgatcgctcaactgtggaggctctctgctcagcaatcgcgctgtatcggcttggctttgatgacgtgcaggaaaacggcatccaaacgccaatctataagagcgtgcagaacaatcgcggtgagattatcgaccgtgattttgtcggctttaaaaaaaacccggctgtatctacgatggatgcagcaatcaggcagatacgctcgctgtcgtctgaacttggcttgacgccaaccagtcgggcatccctgctctctctcactgatgacaacgacgatgatgacgggccaagcctggcagacgtcttgtcgggtggtgatggctggtgatgcgcaagtgggatttaaccaaaaaaggccagacggtcgaaaaagcctatgaaaccgagaaaaacgctggcagttacaatgagatctttaaaaagtatcgcgatccggcgaccagatatgcatttgccgtgcttgaaggtcggcagttagccggtaaaaagatcaagcttgacgcttttcggcatctgcaggacctaagacggcagacggaagacaccgattttaactatcactatgatttggacaaatgtcgggcaatcatcaactactcaaagctggtccctgacgttaacgccggtaagcccttgccattgatgatgtgggagcaaaaaattctgtgttcagtcattggctggcgtgatgataatgataagctccgctacatgcgggcgattttttccgttgcccgtaccaacggtaagacctatctggctacgattttgatgtcgttttactttttggtggaatcaaaaggccagatgaaccacgactacctgtatacggcaccggttacgagtcaatcacaaaaaggtttccagtatatgcagtcgttttttaccaagctttcgactttgccggcttttaaaaagctgtttaaacagcaagaaattgttgtcctgcatgatgtgatcctgtcacggaagctacacaaccgcctactgcggatgtcgtataagtccggccaatttgactcactccactgtcagtttgcggtgggcgatgaagttggtgatgaccaccatatcggctcgatcatcgaaggtaacggcaagatcacatccgggcaaggccaagagcctaatcactgttttttgcaggtttcaacggcttatccggacagcaactcacagttttacaaggaccaacagatgatggaagaggtcatggagcgcgactatgaccgctctttggacgataacctgtgcatggtctgggaacaggatagccttgatgaaacaaatgacccagagacatgggtcaagtccaatccaattttggatttgagccccgaaaagcatgatcagttgatgaaatcgctgctctctgagcgtgataccaagatggcgaacggctctctgccggaatttcagaacaagtcgctcaacatgtggctgcaggttaagcagaacacgtatctggaccttgatgatatcaatcgggcagcggttgatgacgctccgatcgacattgacggccgcgaatgctatgtgggctttgacaagtccaatttcagcgatgatacgtcaatcgccttcgtattcccgtatctggacaacgataaaccgcgctactacgtcaaacagcatagctgggtaccgcttgcgcgggctcagaacaacattgttttgaaagaaaaacaagatggtatcaactatcgagacgccgaaaagcgcggtttctgcgatatcgctaaaaacgactacggttatatcgatgacggtgcggtttttgactggctgatggcctatgtggaggctcacaagctcaaggtcaagtacttctgctatgacaagtggggcttgtccaaaatgattggctggattgagcagaaaaccgactggaacacgatgccagttaagaacgtcattcaaaaccttaacgaaccgaccgctgatctgcgcaaacagttcgacacaggcacgatcagatacgaccatgacccaattattgcgtactcgcttaaaaatgccgtgctgtacggcaataacaacggtgtaaaaatcgataaggaaaaggcgacgactaaaatcgactttgtcgacgcattgattgacgcgtggtatacggcaatgtttcattttgacgacatcagcatggaaaaattcgacgccaaaaacccgttctcggggatgtcaaacgatgatattaacgactactttaccaatgatttttcattctgaaaggaggaaaccgcatgattaagaccatttttaatctgattctggcagttgcggtcgtggtgctgtgggttgcagcactctatgccttcgttaagtttggctttgccgtcaacgtggcggtaggctggctgacactgtcggttgcactgtatctgggctcacgcgtgatctcagcactgattggcggtgatgactagtgtttaatccattcaaagcggtgatcaaacgttcgagaatgcttagctcgaacgggtggtcaccttttttctcggcatcaaacggacaggtcgtgtcagtcggtccagtcaatgcgagcgcagcactcaacaactctgacgttttcgcagtggtctatcgtatcagctcggacgtagcagcatgccggtttgaggctccaatggtcgactacatgcttaatcatccaatgggcccgcttatcaacagttacaacgtgtggcagtcggtggttgctcagatggcgctcaacggcaatgcctacatgatgatacaccgcgaaggtacggatggcgtggtaactcggcttgagccgattccagaagagcgtgtgaccgtaacgcttaacgatgacggctcagatgttttctacacggtccattttgacgactccaaccgctctggcgactatcaggtgccatcggcgaacatgctgcacttccggctgttcgtcaacggccagagcgagtcgcagtacatgggtgtcagtccgctgatgagtttggctaaagagattgacgtgcaggaccaatccaatcgattggctttgagcacgcttaagcatgctctggcaccgactaacatcctgtcaatcccacaagggacgcttaacgccgaagctaaggccaatattcgtgacgagtttgaaaaggctaactccggtgaaaatgccggccgagcaatcgtgcttgatcaaggcttgtcactgagccaattgacggttagccccgacattgccaaactgcttgccaataccaacttcagccaagcccagatcgccaaagcattctgcgtgccggctgactacctatcaggtaagcaggacgagcagtcaagcattgagcaggtgcggagcctgtatcaaaactcgttgacgctttatatcaggccaatcgaagacgagcttaccaataagcttggcgcaccggtgcacttggacgtctcaacagcggtcgatatcgaccaccagcagttgatcagcaacattgtcagcctaaccaacagcaagaatcctgtcttgtcgggtgacgatgcacgccagatcctggttgatcgtggcgtactgccaaaacagacgtaccagacggctacgccaggaaatcaagatctaggaggtgatacgagtgtcaacgacaacggacgtacgaacgctgacaacggacctgacgacacgaagcagtgatgacaatggtatgacggtcgaaggatacgccatgctgtacgatcagccgtcagtcccaatgccgttcgtcgagtatatcgatcgcggcgcactggacaacgttgatctgtcaaaggtcctgctgctgtacggtcatgaccttaacagcgtcttggcccgctccgatgcggaaaacctgcagttgcgggccgatgataagggattgtggtttcaggctacactccctgatacgacactgggtcgtgacacgtataccaacgtggataatggaaatctcaagggatgttcggtcggctttaagattggcgatgacaaatggctgcagggcaacgacggcaatgttatccatcatatccggtcgttcgaccaactgattgagatctcaatcacgccgattccggcctacaccgaaaccagtgtggacgtacagcgttccttagaagcattcatgaagggagagaacgaagtggaaattgactacgacaagttggctgatgcggtagctgacaagattgaacaacgatctgccgaacaaacagacgttgaaactaccgatgaagccgacaagcaagacgcggaaacgacggaagaacccgttgaagaaccgcaagaagatgaagaagaacaatctgctgatgattctgctgattctgatgacaagcctgcaaaaaagcctgcagaaaaggttgaaaatcctgcagaaaagcctgaaaagcggtctgaaccgcatgcagaaatcgtaactacggaaaacgaagaactgaaagaaggtactgaaatgcgtgaattacacggtgcaaacgagtctacaaaggaccaattcgcacactttctgaagacgggtgaagttacccgtgataacacgtctggtggcattggcttgtctaacggtcaagtgctgatcccacaagacattctgccagccgaccacgaacagcaccaattcccacgcctgggcaatctggtacgtcaaattgccgttaagcacacgactggtaagctgcctgtcttccaaccgggctctggcaagctggctctgcacacggaattgcaatctactgctaacagcacgtcgccagaaatcaaggagatcctgtggaatctgaagacgtacacggggcgctacgtatttacgcgagaactgatggacgactccgactacaactgggaagctgaactgcaatcccgactggtcgaactgcgcgacaacacggaagacgatctgatcgtaactcaactgaccaacggcattacggctgttaagccaaccaacctgattgacgatttgaagctgattctggactccaagctgaagccatacgacagcaacgcatcatcgattgtgctgagtcaatccgccttcgctcaactggatcaaatgaaggattccgaagggcgtccgctggtacagcctaacgtaacgttgggtactggcaatgctattttgggcaagacggttacggtcgtagacgacacgctgttccctagtgcaaagcaaggcgatgtcaacatcgtggttgcaccactgcaaaaggcggttatcaagttcaagtccaatgaaatcaccggccaatttgtcgacaccaacgacatctggtacgaggctctgggtatctacatgcgtgaagacgttgttcaagccaacaaggacgtcatcaactgggtatccagcacgactacttctactcctggcaagtaagagtgtggaggtgatcagcaatgattgatacacagtcaatgctcgatgagctctgcttggacgcaaccgatgagacaacacaactgatcaccgacctgttaagccagtccgaaagtattatccgtgactcagtcgacaagaccaagtcgattgccagctatgagcaggatccaatttttattagggctgctaaaacgctgtgcactcagctgtactatgaccgtacgttgactggcgggatgtcactgggcttgcaaatgatgatcaatcacttaaaaggcgaggtgggagcagatggctacaaaccgaacagcaccgtatagctatcagccgtatcagatgcggtataccgcagagtttggcagttttgacatggcagaaaacggcatgggcatcccgatgccaacttttgtcagccagtttaagctgcactatgcccgtgtcagtcagacgatcagtcaaaaatatgaggcactcggcacggattttgaaaacacccagattctggccgtgcgtcacgacaaacggctgaccgacaagcttgccgtgcaaatcgacggcaaggtatacagcatcgtggatctctcagtgcgggacgacatctatctgtcatacgacttggtcaccatcaagcgctacaaagcgggtggtcaagatggctgatattgagatgagtcagttccttgagcaatggcttgaggatgttaaatcgatctcggttgacttaacgccaaaagatcaggctgaaatcacgaaagctggtgcaaaggtgatggctgaacggttgaccgacgttaccaatgccaaacaccgctcccaccacaatgacaagacgtatggccacgccgccgaccatatctcgtatatggctaaagacgtggacggcgaaactaatggctcatctacagtcgggtgggacaaccactatcacgcaatgaacatgatgcgcttgaatgacggctataaggggtattctggcgaccattttgttactaacctacagcaggacaaggcaaccggtgaggccgtcttaaaagctgaaagcgacaagtaccaggaactgatcaatgataagaaaggggatgacgactgatgctggcaacgaaacgggctaaagagctgatccagactggaaattttaaaaacgttgacgctgtctatattggcgttatcccacaatctgagatcacacgcactgaccggacgatcatactgatcacggacgtgcgcaccgacttggcacttgatgggaacctggacttccacgctcttgataaagaggttgaggtccagattttttatgcgctcaatgccgatgatcccgacgaatttgagacatcattgatgcatctgtttgtccgcaatggctggacaatgcttaacaatcatggtcacacggttgaccccaagacttatcaggttacacaaacctactactttgactactacgaacttgaaaaataggaggacaaaacatgttacttcacggtatcacaaccgcgtgggttttccttaaatccaatgacggtaaaaacttgctgactaaagaacaggggctatctgacaacggcttgctggaactgggccatgacgtgctcggtgtagcgtcagcagaaatcaagggccttgacggctcgaagctggaaaagatctcaggcaacaacacggtacagtacagctatgctgatccattgaacccaacggttgctctgacggtcaacagtcttaagatggctacttatgccaaattgatcggtctggaaaagcagggcactggttggcagatggctgacaacaaaccagtgggtggctgtgtcgtcaaggcaccacatatgaccgatgacggttacacctatttctgtttcccaagcggcaacttcttaggtggcgacaagaagcttgattcggataccgactcaaagaagacgccagtaacggactcactgagttttgccgcgattgatgatcctaacatcaacgatctgtatcggatctacgactccaccgacaccggctttacaggtgaagacgcgatgtttaaggaaattctgccagactacgctacgacggttgtggctggtcaacacgcctaatagttaaagataaagatcgccaacgaaagcaaacaatactcgtatgagggcggtcgatagaggagagataaaatgaagctttatattaaactttttaatcgtaagtttgacgtatcgacgtctaatggaaacgttcggcgcgtctacgagatgcaactaaaaatcgctaaaactcaagctgaaaaggatgttttaaagcgagcacaagacgagctggaattggtccaagaactgccaaagtttctcgggaccatgctcaagcttaacaagcagcagcttaaccagcttgacaacatggattttgaagcaactcaagacgcagtcggttacatctgccaacgcattttaggtcgcactgatgagcagattaccgaagaggaaaaagaagacccaaaaaagtaaactggaaagctcgtgcatggcatctgcagaatgcgattgaagacctggataataacgagcgagaaatgctgattcagctacattggacgatagatcagtacgaaaatgccgactactatcgtctaggtgaggttatgtcagctaaggcacgtgatgagcgtgcagttgacccgttgcagtttgtaagaggaaggagagcggataatggctaagatcagcaacgttatggcgactaaggtcgcactggatttggtggacgcatctaagtcagtccgcaatctgacgacagaagtcaacgcatcaaccaaagcctggcaggcacaggaagccagccttaggtctgccggcgactatgttggcgcggctaaggcacggcttgacggtctgggcagttcgattgatgcacaaaaggaaaagatttctgctttacaggagaaacaggaatcgatgagcgaagtcagccaagaaacggctgaaaagtttttaaagctcaaagagcgcattgacgaacttaaagccgagcagtccagtcttgacgacatcactggtcgcaacaaggaaaaatacgagtcgcttggtgctgaaatcaatcgtttggaagctcagcaaaacaagctcaatgtgggcacggtcaagcaagccgagatctatctgcgctacggcgcacaagtcgaccaggctaaagccaagctggcaagcatggaggctcagcaacagcgggccgaacagcagctcgaactgcagaatagcggcgtgctgaaacttaacgcgtccatgcgggcacaatcagcgctgtttatggcgcatactgagcgtctacaggctgaagggcgtcagtaccaggctatgggagcacaggttgatggtctggaaaacaagatcggccaactgagagaaatccaacagcgtgagatgcagatgcttgaatccacacgccagcggatgggtgaaaactcgcaagagtatctccagcaggcaacccgtgtggaagagcttggtactcagattgcgcagacacggtctaagatcaacgagcttaacgaggccatgaaggctacgccgcatacgtggcttgatggcatgaacgctcgtctggacaatctgcaaggcaaggctgaccgagtaagccactcgtttggcagtatgttcctggctaacacggcggctaacctgttttctggcgcgctggcaacgattcaggctcactttacggagctgattgccagcgggcaagagtatgacgttactcagcagaaaatggtagccgcgtgggatacgctgaccggttcggctaacaaggctcaggacatggtcaacacggtcaacaacctgtcagtcaaaaccggtcaagccgttgacactgtggacgaactggagcagggattctaccacctgcactcgtctaagagccaagccgacgggctgaccagctccatgcttaacatggctgacgcggtcgggcttaacagccaacagatcaatgacgtatcacaggatatggtccacgctatggcaaccggcaaggttacacaaggtgagcttaaccagatcggtgcctacttcccgatgatcgatgaggcgctggctaagcactaccataccagcgttgccggaatgcgtcagatcgcgagcgcaggtaagcttgatgctgacacgttccaacaagtatttgagcagttaggtaacggtaagtacaaagaggccgccgacaacatgatgggcaccttctttggcatggaacggacgatcaagtctcgtatgccggcccttgtcggcgatatcgaacagccgttcatgcaaatgagcaatccactgcttgagtccgtgtcaaagtgggtatcagataagcgtactgacgcgctgtttacccagtttggtcagcatttgatgcaggcgtttaatcagatcacgaccgcttttggcggcaaaaagatcaacgtcagtgatgcgctgactggcggaatggaagctgctactcgtgccgttgaccgttttgcaaacgtggtgtcatcacaccatacgcagatcaaggaattttttgactcgtttaagactggttcggcggcgagccttaagatttttgctaatgtcatgctcgacttgtctaaggtaatgctgccggtcttggatgagttggctaaatacccgaagacaaccgcagcagttattacttcccttttgttagcaagcaaggctgtaaaaggattgtctgtggcggtcaagggactgcagatcatgcggacggtcggctcaacgattggcagttttgcgactaagatcaaaaacatcccaagtcgcaagattactcgcattcaggtcgacggcgccaagtccacgcaggatttggaagcctacagccggcgtttggaccgtattccgaagtccaagacgactaaggcaatcgtcaacacggcatctgccgaaactagtctgacacggcttggaactaaagcgaccgtagctggtaaactgggctcaagcgggctcagtttgattggtcgtggtgccaagattgcatctgccgggcttgacttaatcggtggtccagcgggtgcaatcatgcttgtcgtacagggcttgacaatcctgtaccagcacaacaaaaagttccgcacgttcgtcaacggattggcaagctcagccatgtcggcaatgggcaagatgggcaaggcttttgagtccggtgctaaatcggcaatctcgtggaccagcaacatgtgggaccgtgtcaaaaagagctatcagcaaggtcaagctcagactcagcagcagactctgcagcatgcacgccaacagcagaaggcttggaacgatatccgtgacaacgtcactaatgccacgcgggatatgatgcacaaagctgggaacctttttagcaacggctacaacggcatcattaacaccacgtccaactggcggactaacgcatccaacctttggcgtgatgcgtcgagcaagatccaaaatactgccagcggtttgcggaccaactcgaccaacattttgtcaaaaatgcacgataaactgtctggcatccaagatacaggtttaggccatatgcttggcggttggaaagaccactttagcaaagtcattaacactatcgagtcaaatggtagtccactccataatgcttttagagatattttaaacggcttgcttagtccatttaccaatttgattaacggcattatcaaaggtatcaactgggtcttggataaggttggcggtgacagccataagcttggaaccttcacgattggcaagcttgctaacggtacgccaggaggtggcttactccatgaccaggtagcgctgcttaacgacggctctggtcctaactatcaagagatggtccacttcccatctggcgaaacggttatgctcccaccagagcgcaacttgatgatgtttctgccggcacaaacagaagtgcttgatggagagcggtcagcacagttggcaccgatgatggatatcaatcactatgccaacggtgctgtaggtgatttcttctctggcctgtgggacaaaggtaaggatgtccttggctttgctgaggatatccttaaaaagccaatcgactttatggagtccacctttaagcacttcatctcgggcaaacttgacaatggcgggttcttcagtgcccagctgcataccagtctgccagtgttcttcgccaaatcaatggctgattgggtaaagaaacaattccgggaaatggctgatcctgccggctcaggtgttgacagatggcgaccatacgttgtcagagctttggacatgctacacttaagctcatcgcttgtcggcaaggttttaaagcagatccaaactgagtctggtggtaatccgaaggcactcggtggcgatgatggtttaagcgatggtcgagctatggggctgatgcaggtcaagccacctacttttgcagcctataaactgcccggacataacaacatctggaacggttttgacaacctgttagccggtcttaactacgcgcgacatcgctatggtgatggtttgtcgttcttgggtcaaggacacggctatgccaacggtggcatcgctactcagccgtcaatttttggcgaggcgggagccgaaatggcaatcccgttgaacagcatgaagtcatcccgtgcgtgggagcttatgaggcaggtcgttacctactatggtggcaacaatgccacaagcaagacgtctacggttgatacgcggaatttatcgcaacaaatccaagaactgattgaaattagcaaggctgttttggcagttaatggtgaacaagtccaagctattcatggcattaaaggatacgacaaagtaactgcctataaacagcagcgaattgaccaaacgctttcaaactatcaagcattctaacgacatgaggcttataactggtcagcaaaatgtttttcactgcgtctgagaggggatgataaaatgcagcgacctcatatgtggattaaactgccaaaccaagatgaaattgactgcgaaacgataactaaaggtcttaagtttctgcaagacgattccgacttgtcgatcaccaacacatacttggattcagccggaattgagggctcggtcttggagcgtcagacctactccaagacagccgttaatgctaatttttggctacactttggtagttggtatgactacaaacttgctaaacatgacatcgcacgtgtttttggccaaaaaggactgatgcggatccgcactgatgctgaaccgaatatcgttaagtatgtatatgcaacgtcatatacgatcaaaccaattggcgatttttatcatgatgctctttttacgatcacatttgataatccaagcggtctcaaatattcgctgtatcgcagtgatgaacttgtcaatcatcaaaacgacggcaagcagtttgggatgaacctgcctaatcagccacttaactatcactggtcgtcaaactccatcgagtgctacaacccgtcagacattgcggttgacccgtactttggcaagcgcgacatccgtacaacaattcgtttttcgggtagttcaatcaagctggaaaataaaaccaccggttctgcttggacttatagtcaatcagccagtgccaacgatacgatcgtgattgatggcatcaacacctatcgcaatggtgagcttgataatagtcataccgactacgggtatctgaatcttgcacctggcaataacttgattcaggctacgggtgcatccagtgtggatgtcacaatcagtttcccgtttatctatctcgagtaggaggggatgcattttgagcgttgtaaaaatcgcaaaaatacagggtaacctgcacgtccctaaccctagtgacacaatagctatgctgacaagcgtcataccagatactatgcagataacgtggaagaaaaacagcgagtatcagatgcagtttgaggcttacaataatgggtctgatgcttattcaatgctttctcccgggaacatggttgagaaaaatgggcaatggtttgttatcaaacatcctaaagcgggatggtcaggaaatctggaaaccacatcggttgtggctacacatatcagctcagagataaatcgaatccgtatctatggcgatgatgctccaaccgattttggcagttatgaccatgctggcaaaagccagtcagtcacgagcgtgtctaatggcaatgccgagactgctgttagcgtgtccgtcaacgatatcatgcagtgggcctttggcgatcagcaaagccgttgggggatcacctatcaaattatcggcagttttaacagtcagatggccgtcggcccgtacgcatctggatctggcaaggatatcatcagccggatcttagcggcatggactgatacagttttttggccagataaccttaacttaagaatctactcgcatgacgagttttacaaaaatcgtgggcaccggttagactacctgcatgatactgatacggtgacgcttgagtacgacactactgatatggttaacgcggcaagactggtcggggctatgcaagagagcggtggcggatcgtcgaagacagttgacaatgccgaaattaccaatagcgatagtcaaagcacttattatttcgcaccattttactttgttgatgaagaaagcaaaaaacgctggggcttgtacgaaggtgatgacatcaccagtgatacgataaccgacaaagaacagatgaaagcttacgctgaggcgcaatttaagcctaatcctgatgtaagtctcgaactgacggctatcgattggcaagcgattccaggcgatctggtaagagttgagatcaagccagccaactacgttactcagaccggcgttgttggaatcgtaagctatccagatagtgctgccaaaaaaactacggttacgctaaacagcaatttgcagactatccttgactatcagcgtggtcaacaggcagagctcaaatcttatcgtgacagcactaggaacatgatcatcaacgcgcagtttaatagccaggtgcagacaacgtggaacgaaacggaggtgaaggcatttgacaacagcaaacgtagttgacgtatcggagtggcagccgaccagaatcgactgggccaaccttaaagctaacggcgtcaaagcggtcgtcgtgcgtatcggtcatggtgtgacgcgtgataaaaacgcagccgaccatatcactaacgcgactaaagcggggctgattgtccatgtctatcactactacgagggcgtagacggtgagctgcagtattcggtcaacaacgctaagagcctaaacattcagccgaacgtgtactacttcctggacatggaaggcacgatcgctggctcgtggccaagcattttcgactcgtttcgcaagcagtggccagcgtatggctggaataccggtctgtactgctcactaagcaactacgcaaagtttgacgacgtcacgcttgttaagcagggcgtgtaccgctggattgcggcgtggggcagtgatcagccaagcaatgccgacatgtggcagtatgacagcaagaccggtctgggtagctacgcgagtgcactggacaaggacgttgacattgccggcaagttggtcaaagagccgggcagcacgattgttgagccaaccgacccgaacggcaactacacgatcaaacctggcgcatttgttgggtttgactacagtaccaccgagctacaaggtggggcgatgctggttgccagcccagacggtcaaaacaaaattcccaagctgtcgccagacggccagtttttgtttaacaacaaagacggggacaacatgtggacgctgatcaagccaaaaatcagcacgattaaaggcgagaaaggcgacaaaggggatgccggagctaacggcaagtctgcgtatgaagttgccacagccaatggctacagcggcacacaggcacaatggcttgcgtcgctgaaaggtgctgatggcgtgcctggcaaagacggttccaacggtaaggacggccaaacgtggcaaccgtatatcgcagacgataagcactggcacatccggctgattaacaacgttgacatgccggctatcgttggtgtgtttttgtttgaacccagggatctgagataccatcaatggttaagattcaacccggttcgttgtggagtgcttacgatcattcaatcatgatcaaatattaaatctacttataactactaaacctaagcttagtaataacgtcactagtccaattaacatcatacccattgatgatccatcacctgtttgaggtaatctacttgttttatcgtacattttaccttgagtgaaatcctttggtgttaccttattcccattattaggaacttgaggttccttaggcgttgtcgggttattaggaacctggggcttcttaggcgttgtcggattatgggtattagtaatattgtaaccatcaacagtactggtgtaccccgcaactgcatcttccgtaactgtgtaggtaatcttctgaccattagcataagcagctaagttgtcgaaactgtactgccagttatcactggcactaactttcttgcttgcaacttgttgaccattggccaataagtttaccgtgattgaacttggacggattccatcttgattgttgttatccctccaagtcttcgtccctgaaactgaggttttctcaatcttatcgataattttaataacggccccttttgaatcaaaatttgtagaagttacgattaccgtatctgctaattgatatcccttaggtgcactgacctctttcaatggtagcgtcaagaatcttgtgtaaatgaaatgccttcgtacatataatatgtatttaacttaaataaatgatgcttccaaggtgtcctggagtcctttgaaccctcggtggatccgcttcagagaattctcgttataaacattaaactgagaaaccaggaagcgatccagtgaatcttccgttggaaattgttctttgtggtgggtggtgcgcttgagatgcttattaaagttctcaatcaggttagtggagtatagtgattgccggatagctggtggaaagtccatgaaagtgagtaagttcggcaatttcagcagtggtaattcccttggtatacaactgaatgaccgttgtttctaaattatcactgtgccgaccgtaggctggcaaggtatgattttcaaaccggccattgcgatctcgaggaatggttaagttaagttggccgtacttcgtatcaaacgagcgctcataactgccgttgcggttattaccagtgttaatcccagcgtatgagtagcgttcgtaacccaaaaactctgccaattcggtttgaagcagctggttaatcgcaatttcgaggtggtgacgaaaaacttcgtccaaatcttacttttgggctagtgcagcgataatttctgtggtaagttcattcatggggaatgcctcctgtgatgttttctgtggttactaaatatcataagggaaggcattccctatttctatacaattcagaaatcttttatgcatttacacaagatattttacgctctctgcaaatgtgcaatccgaacgatgacctcaaatggtcggtttagcgattaaccaagtaaaacgattgatttagtgaaaacgggtgcacaaaattaggggataccagaaaggggcttgttaaatcacgcttaacaggctccggttagaaaatttaaaaattagtttgtgaaattttgggaccgtttccgaacgccggaatgttgatgtaaaacgatgtactgacgaacgttaggggaagcgctatcatttttcacaaagatcgccaagggagacgctttacttttccttaatcaatgttattcttgctttaagaaatgattcccccactggtttgctagcggagggatctttgttgctattattcattaaataaaggaaaggtgttttcccatgtatcttgcaatcaatattcttgggataattgtcttcttggcaattggattcctcttctccaagaacaagaaagcgatcaactggaaggccatcgccatcatggtggtcctcaacttggtcttggcttggttcttaactggttctgctgccggacgtgccggggttaaggctgccgctgacggctttgcctggattgttgatatttcctctaccgggacgatcttcgcccttggtggttggtatgacgcaaagaacttaaacttcatctgttcggcactgatgccaatcctgatgattgttccaatgtttgatatcctgacttacatcggggtcttaccttggatcatcaagtggatcggacggggcctgtcctttatcaccggccaaccgaagtttgaatccttcttcgccgttgaaatgatgttcttagggaacacggaagttctggccatctccgggatgcaattacggaagatgagtcgcgaacggaacctgacgatcgccatgatgtcaatgtcatgtgtgacggcgtcgatcttaggggcctacatcgaaatgatgccggggcaatttatcctaacggcggtgccgattaacattgtcaactccctgattgcgactgcgttaatgaacccaatcgttgtaccagaagaagaagacacgattgaaaccatcaagcaagaaggtgaaaagcgtgaaccattcttctccttcttaggggattctattttgggcgccggtcggttaatcctgatcatcgtcgcaaacgttgtagcctttgttgccttggccgccttgattgacaagctcttggccttgatctggaagccactctccttggaagccatccttggggttatcatgttcccattctcctggttaatggggctgccagtgcaccaagcctggatgctttcccaagacatggggatgaagctggttaccaacgaattcgttgttatgggtaaggtgaccggtgtcatcaaccaatacccagaacacttaaaggccgttttgaccaccttcgtaacgtcctttgccaacttcgggacgatcgggatgatcatcggggccttcaagggtctggttggtaaggaagataacgactacatcgccactaacattggctacctgttgttatccgggatcttagtatccctgctgtccgccgcaattgttggtttgtttgtttggtagaactaggagtgggaaccaacccgttcggcagaccgtttggctaagctagggcaaaggttggtgccatcagcagcgttctttgtccgtacttagacactaggcctgcggttggttgccacgttatctgtgtaacagccaagaaattagacaagaggttaggagaaaacgagttttttcccaacctcttttcttcccgctaaaataaatgcgttttcttaaattggaggaatgaacatgacgactaaaattattatggatactgacccaggaattgatgacgcagccgcactgacgatggcgatcaacgacccgagcctggacctgaagctgatcactacggtggctgggaacgtaaccgttgataaaacgaccgccaacgccttaaagatcgttaacttctttggtaaaaacgaccaaatcccggtggccggcggggcggtggcgccgttaatcaagccgtttgaagacgcggcccgcattcacggggaatccgggatgccgggttacgacttcggcgatgactttggtcaaccgctagcaaagacggccgtcgaagccctgcgcgacgccatcatggcagaagatgaggtgaccctggtgccaaccggctcttacactaacatcgccctgctcttctcccagtatccagaggtgaagtcccacatcaagcaaatcgtggcgatgggtggttccatctccggtgggaacatgacctcggccgctgagttcaacgtctttaccgacccggacgccgctaagatcatgtacaacgccggcgtaccgattgtgatggtcggcctggacgtaaccttaaaggccctcctgaccccagccagccaagagaagctcctggagatgggcgaagccggcaagatgcttcacgacctggtgacccactacaacgacggggacgaccaggacgggcacccgatgcacgacgttaacacgatcttctacctcctccacccggaggccttcacgaccaaggaaatgtggatcgacgtggtaacggatggcccggccattggggctacggttggtgacgttcgtggcgcctaccacgacggcaaggtcaacgctaaggtctgcgttgacatcgacgccgcggccttcaacaagtggttcttagaagaagtggcggcaatgaataagtaatagagtaggaaattcagagaataaataaaaagctgggagaaaagcacgcttttctcccagcttttttggcatcatttcccgggaaatgattcccgccagaaagccggagatcgcttgaaacaacgggcttattaaggtaaagtggtagggtaacgtggaacaagatgtttcacggaaaggaaaaagatatgaacccagaagaatttcgtcaagccctccttgaccacggcattgcgctgacggacgcccagatggcgcagtttgcgcgttactatcagctgctggttcaaaccaacgaacacttaaacctaacggcgattacggccgaaacagaagtttacctgaaacacttttacgattctttgactggggccttcgcctaccctaagctccaaagccaagccctgactttgtgcgacatcggggccggggcgggtttcccgtccttgccgctgaagatcgtctttccccagttggaagtcacgatcgttgattccctaaacaagcggatcaacttcttggccgacctgtgcgacgacctcggtttgaccggggtgcacctggttcacgaccgggccgaaacctttgtggccaaggggagtccgtaccgcgaacagttcgacttagtaaccgcccgggcggtggcccgcttggtggtgctcggcgagttgtgcttaccggcggccaaggtcggtggggcctttttggcttataaggccagcgccgttaatgatgagttaaaattggcgaccggagcgattaacaagctgggtggccaggtggcggggacgaccaagttgaccctgccaaccaagccggaagcagaggagcgcaacctggtggtgatcgataaggtcgctaagacgccgggaaagtatccgcggcgccccggggtacccgctaagaagccactgattaacgtctagcaattgaggagtagtaaaatggcattttcattgtttaacattgggaagagcaaggagccggttaaaaaccaagtcgtggaggttccgctggcgcagatcgtgcccaatcgctaccaaccccgccaggtttttgaccaaacggcgatccaagaattagcccaaacgatagatgaacacgggctcttgcaaccgatcatcttacgcgaatacgaaactggtaagtacgaaatcattgccggggaacggcgcttccgggcgatgagcctgttggattggaccaaggccccggcgatcgtcgaaaagatgaacgaccaggaaacggcctccttggccctgatcgaaaacctgcaacgttcgcagttaagcccggtcgaagaggcccaggcttatcaacagttgatggaactcaacaagctgactcagtcggccctggccaaggggatggggaagagccagtcctttgtcgctaacaagttgcggctcttacaactgattacgccggtgcaaaacgcaatcatggaccacaagatttccgagcgccacgggcgggccatgctcagccttagcgaggaccaacagcgcgacatcttaatgaagattgttaataacgactggacggtccgccagaccgaagacgagatcgcccggatgcagggtaagccggtgccaagcgaagtggaggcccaaaagcaacgcgaactctttggcctcgacgaagagttaacggtcaaaaaagacgacgcgcaggatcaaccggctaaaaagaagaaggcgccgaagaaaaccaagaaggtggccagccggatcaaggtatccgacccacggattgccgtcaacacgatcaaggaatccttgaagttagttaacgataacggctttgagaccaaggtcaaggaaaccaagaccgctaacggggtggagttgacgatcacgatcgttgccccgacggactagtgggggtgatgcaatgagtgatgcaaggcaactgaccgccccgcccggcccgggggaagtggttagggagttggcggtggattcaatccgccccaacccctaccagccccggcgcacctttgaccaggagggcttagcggagttagcccggtcaatcgaagcggcgggggtctttcagccaatcattgtccggcgcccggaccccaatttgaaccgctacgaattaattgccggggaacggcgcctgcgggcgaccaagatgactgaacgcaagacgattccggcgattgtccgggtcttagacgaccagacaatgatggcagtggcggtcctagagaacttgcaacgcgaggacctgagccccttagaagaggcccaggcctaccagaccttgattgaacgcttgaacctgacccaggcccaggtggcggcccgcttaggcaagagccgcccctacatcgcgaactacctgcgcttgttaggcttgcccgaagaggttaagcagatgctggccagtggcgagctatcgatgggccaggcccggaccctcctgggggtcaaggacgaacggcggctagttgaactagccaagcgggttgcaaacgaggggctgaccgtccgccagctagaagagatcgtggccgggattaacaagaaggggcgccaaaagccagtggttaaaagtgccaacccttacttacgagaggctgagagtcaactagcgggtaagtttggtgccaaggttagcttgcaggccaagcgccgcggcggtaagatcgtgatcccctatggttccaatcaggatttaaaccggattttggaactgctaggggtgcactttgattagggggtagtaaagatggaagaatacgcattaaacgacattgtcaaaatgaaaaagccccacccgtgcggggtaaaccggtggcagattatccgggtcggtgccgacattaaaatcgagtgcaccggctgtagccacattgtcatgatgagccgctacgactttaacaagcggctcaagaaggtcttagaacgggccgaacaagaagaggattaaaggagtttttaaaccatgtcattaactgcagggatcgtggggttgcccaacgtcgggaagtcaaccctctttaacgcaattaccaaggcgggcgccgaaatggctaactacccgttcgcaacgattgaccccaacgtcgggatggtcgaagtgccggatagccgcctggcccggatcgatgaactgatcccggccaaaaagatcgtgccaaccacctttgaatttaccgacatcgccgggatcgtcaagggggcggccaagggggaagggcttgggaacaagttcttggaaaacattcgccaaaccgacgccattgttcacgtggtgcgggcctttgatgacgatgacatcacccacgtcactgggaaggtcgatccggtcgacgacatcgacacgatcaacctggaactgatcatggccgacctcgactccgtgaacaaccgcttggccaaggtgcaacgggcggctaaggggcgcgacaaggacgccctagccgaactggcggtcctagaaaagcttaagccggtcttagaggcgggcaagccggcccggtcggtggaattcagcgccgaagaaatgccgatcgtcaaggggctcttcttattaaccattaagccggtcctgtacgtggctaacgtggccgaagacgatatggccaacccagaggcttccaagtacatggacgtgatcaaagaacacgtggcgggcgatggtgaagtgattgggatcgccgccgccgccgaagaacagatcgccgaaatggacgaagaagaaaaggccgacttcctggaaatggaaggggtagaagaaccaggcttaaaccgcctgattcgggccgcttaccagctcttgggcctggaaaccttcttcaccgccgggggcaaggaaacgcgcgcctggaccttccggaagggcactaaggccccgcaggccgccgggattatccactccgactttgaacggggctttatccgcgccgaggtcatgtcgtttgaagacctcgaccagtacgggagccacgccgccgttaaggaagccggtaagctacgcctggaaggtaaagactacgtgatgcaagacggcgacatcgttgaattccgcttcaacgtttagtcaggatagagaatcgattgagaggacaccaccgtgagtgaacaggaacaaagaaacaccgctgccggacaacgccagcgccaacacccaaaagaagaccggcaaaagaccgggatgatgtttgaaaacgccgggttgacccgtaagaatgaagacttcatgtaccagttaaataagcaactggacgcccagggggccacggccgaagccaagccggccctgctagaagaaaccatgaccgccctcttggaaggtcaaaagacggggcaaaccgcgaagggactgtttggaacgcccaccaagcacgccgatgaactcctgcacccgaagaagacgccagctgaacaacaacagacctcgaccgtcttgatgtcggtagataacgggctaatgtttttcgccatcttcaccttcatgtttgggctgatggggctgatgcaaccgtcaaccctgaagctggcccaacacgggagcgccgggctggtcgcgatcatcttagtcgccgtggccggtggggcgtccttcgggttcgtcaacaagattttgttgccaacggtcgatgaaaacgggaaacaacaccgccggccgctgtggctccggattgtcctggtgttaggggcgttggtggcctggatcctggtctacatgctagtggccttcttgccaaacgccatcaacccagtcttaaacgcctgggcttatctaatccttggggtagcgaccttcttcggcgacgtttacttccgccaacgctaccacattgtcgggggcttctggggctcgtcggctaaccggcggcgccgttaaggaagaaagtggcaaataacctacccgctgggtcgccacgttttctgtctaacattaaaaaatacgccagaggctgggaaaagttctgttttcccagcctctttttgcgttctaaaaccgaacgttattcggggagcttcggcagggagttccataatttgggcagaaaagatgagaatcaggttagaaatgccggaaatgattgaccaaagccgatatatcgagtaaagtactaacaatataaatttttccaaaggagtgctgttcaaagatgtcaaactgggataccaagttcgccaagaaggggctaacttttgatgatgtgctgttgattccggctgaaagccacgtgttaccaaacgaggttgacctgtccacgcagatcgccaagaacctgaagctgaaggtgccatttatctccgctgggatggacacggtgaccaaatcatcgatggcgatcgccatggccctgcaaggggggatgggggtcatccacaagaacatgccgattcaggcccaggctggtgaagtggccaacgtgaagagcgtcgccctgaactcgatgatgagccacgccgccgtcgacgaccaaagccgcctgctggtggccgccgccgttggggtaacgtctgacacctttgaacgcgccgaagccctgtttaaggccggcgccgatgcgatcgtaatcgacacggcccatggtcactccgccggggtgctgcgtaagatcgccgaaatccgcgaccacttcccgaacgaaaccttgatcgccgggaacgtcgccactggcgaggggacccgggcgttgtttgaagccggggtcgatgtagttaaggtcgggatcggccctggttcgatctgcaccacccgggtggtggccggggttggggtaccacaaatcaccgcgatttacgatgcggctagcgtggcccacgagtttggtaaggccatcatcgccgacggtgggattaagtactccggtgacatcgtgaaggccctggccgctggtgggaacgcggtcatgctcggttcgatgttatctgggacgaccgaagcgccgggtgaagtttacgaagataacggtaagaagtacaagtcttaccgggggatgggctccgtgggggcgatggcccaatcccatggttcttcggatcgttacttccagggaggagttaacgaagctaacaagctggttccggaagggattgaagcacgggttgaatacaagggggacgtcagcgatgtcatcttccaaatggtcggcggactgcgctcagggatgggctacgttggggccggcgatattcaaaccttaatcaaccaagcccaattcgttcaaattacgaacgccgggctgcgggaatcccacccacatgacgttcaaattaccaaggaagcgccaaactacaagtaaggcggttgaaaagggaaatgcgtcgcccccaggtgtgggggcgacgcatttttagttgacgaaaaaattataaaaacttcaattttatcaaatgataaaaagtagtcacattaccatttacttattaatatattatctatacacatagtaaaatgttgtcattttactaaggtgaaactcataatgaaacggctttcagttgatgtaaccaagtaattatttttatttaaaataacacttgtaatcgaaatgtgactaaatcctagttgaatacaaataaaaacgtagcaaaataagttaaagattaattaatattgcccatagaagggcgaaaaaggaaggtcagcatggactctgaagaattacaacaccgttcttctcagcaccagcaccaccatcatcaccaccatcaccggcgccgctggctgcggtggttatggattcttgtggggctagttgttgtcgtagcgctcttctttgctggaatggcatggcgaaacgttcgcgttgccaccaacagtatgtattccccgagcggggtggttaagagccggaacttaagtaagttattagctgctaaaaaaccaattaacattctcttactcgggaccgatacgggggccttggggcggagttataagggtcggaccgacacgatcatgatgatgtcggtcaacccgcaaactaagaagacgacgatcgtcagcattccccgtgatatggaagtgaccctgcctgattacagcgatgagtcaccggccaagctcaacgccgcctacacttacggcggggtcaaggaaacgatcaagaccctcaaggaatactacaacgtaccgattgatggttacgtgctcgtgaatatgggggggctagaaaaggcgatcaaccaagtgggcggggtaaccgttaagtcaccgctgacctttagctacgaaggttattcctttgaaaaggggaagacctacacgatgaagggagcccaggcactggccttctcgcggatgcgtcacgaagatcctaacggtgattacggccgtcaggaacgtcaacggctcgtaattatggccctcttaaagaagtcggcttcctataagtcaatcttaaaccagtcgttcttaaacgacattgcggacgaaacgcaaaccgacttcaccctgaataatatgatgagtgtcgccctccactaccggagcgccggccaaagcgtcacttccgaccacgctcagggaacttcccagaccgttagtggggaagattttgaagtagtctcgacgaccgaacgccaacgggtaagcaacgaactacggaccaccctggggctcaaacaagtaacagttaagacggagagtaattaatggaaagcgaaaagaataccaacacgattgacttgcagcacctctggaagctgtttgttcaacacatgcgcatgattttgatctggacggtgggcctcggcgtcatcgcttgggggctagctgcctttgtgatcccggctaagtacaccgccaccacccaaatcctggttaaccaacgcaatagcaacgacaataacggtcaagcttacactaatcagcaggctgatattcagatgatcaacacttataaggacatcatcaccaatcaagtgatcctgaagagtgcttccaagcaattggctaacccgagcgggagccaacgggcctacgcattaagcgtggctaagctaaagaattcactgaaggtaaccacccaaaataattcccaggtcttctccctaagtgcggaggcgggcaacccgacggaggcgaaggtgatcgctaacacggtggccaagatctttaagaagcaaatccgttcgatgatgaacgttaacaacgtgacgatcgtctcagaggcaacggcgccaaccagccagtccttcccgaacaagaagctctttgctttggccgggttggtgcttgggttcttgatcagttacgtttacgtactgcttcgtgacttaaccgacacgacggttcgtgacaacgactttatgaccaacgaactgggcctaactaacttgggtcaagttggtgaaatttacatgccagccgactttgaatttaagccgttcgatgaccaggctgctggtcaccgccgggtctagaagggaggacttttaaatggggttatttaaacaccgttacaccgaatctaccgacacaatggataacggggccatgctaatcacgctggccgacccgaagagcggcccggccgaacagttccggacgatccggaccaacattcacttcatgagcgttgaccggccgctaaagacggttgccttcacctcctcgggaatctcggaagggaagtccacggtaacggccaacgtggcaatcgcctgggcccaagaaggtaagcgggtcctcttgatcgacgccgacttgcgccggtcgactctacacgtcacctttggcctaagcaaccaaaaggggttaactaccgttttgactggggacagtaacgaagtcgaccttagcaacgtggtgcaaaagagcggggttgaaaacctggaggtcttaacggccggtccagtaccaccgaacccatcggagctgttgggttctcagcggatgcaatcgctgattaacggagtgcgggaagtctacgacatagtggccttagacgtgccgccgatgctgcaagtaaccgacactcaagtgctatccagcaacctggacggggtaattttggtggttcgccagggggtgacccaaaaggcagctattcgccgggcggtggaaatgttgaagatttcccaggccaacgtcttagggtacgtgatgaacgacgtttacgatgacgacgctggttacggttatggctacggctatgactacgagggaggtgaaggataagttaaacggaaagggggacttcgatggggctaattgatttgcactgccacctgttgccggggcttgatgatgggtcaccgagcatggaaacgtctttgaagttagcacaagaagcggtggccgatggggttagccattgcttgttgacgccgcaccatttaaatggtcactacgtcaaccacaagcaagacgtgattagggcaacggtagcctttcaagaagcccttgaagaagctcagattcccctgaccgtttttccgggccaagaagtgcgggtgagcgatcgggttttgccggcactagaagccgacgacttgttgtacgtggacgaagaaggccattaccttttgttagaaatgccaagtggtggggtgccgacctttgcccgacagttggtctttgaactcttgcagcacggggtgacgccggtgattgtccacccggagcgtaacgccgccattttggatgatccaagtattctggaggcgtttttggaacagggttgcttgacccaactgacggcggcttcttacatgggcacctttggcaagaagattgaagatttaacgacccggctaattgaagcggggcaggggacgatcttcgcatcggacgcccacgccctagcccggcgcgactatgagttaaatgaaggactagcaaaaatggcccgtgagtttgacccgcacttggctgaacactaccgccgcaatgccaagcggttaattaacggtgagccagttcggatgaagtggcaaccactgaagaagaaacgtaggttttggttgttttagtaaaataggaattatggaggacaacatcttatggtaaaagcacttgtcactggaggggcgggatttattggatccaatctagtaatctcgttagttgaaaaaggatatcaagtgaccgtagttgatgacctatccatgggagtgaaggctaacttagctacggttgcagatcaagttgagttccatgaacatgacgtgtgcgaccatgaatttatgcactccattcttgatgaagactttgactacatttactatttagctgcgattgctagtgtagctgattcggtggaacggccgtatgaaacgcaccaggtgaaccaagaatcagtggtagatacgttggaatacctacgggtaaagggatatcaaccaaagaaatttctgtttacctcctcggcagcggtatacggtaactatccggaattaccgaagcgagaagacagccgagtgcaaccattaacaccatacgcagtagataagtatgcttcggaacgatttacaattgattatggtgacttatacggattatcaaccgtggccgtccgattcttcaatgtgtttggtccccggcaaaaccctaattcaccgtattctggtgtactatcgattgtgacgaactgtctgttaaaggatcagcagtttactctgtacggggatgggagtcagacgcgggactttatctacgttaaagacattgttaacgcgttgattttcattagtgaggcaacaaatagttatggggtttataacattggttacgggaagaaacacgcattgctagacgtaatcaggatgtttgaagaagcggccgggaaaaagttgaagattcaatttgcggaagcacgaaatggggacattcaggaatctttggcagatattacccgtttaaaggaattaggttttaaagcaaattgggggttagaaaatggacttagggaatactgggaatatgcagatggaagaagtaaatagtaaggcgcaaatagcaggaaccacctacgaatacttagaccacattggcgaaccaatcccaatgaagaaaatggtgtggaaacgattttgggatatcatttttggcttaattgggttaatcatcattattccgttcatttttgtttttgggatcattattaaattaacgtcgaagggaccgatcttttttaagcaagaacgggttggctacatgggaaagaactttgatgttatcaagctacggtcaatgcgaaacgatgcagaagctaaaaccggggctgtgtgggctcaaaagaatgacccacgcgtaaccgtagtgggtcagtttatgcgaaagacgcggattgatgaactaccacagttttggaatgttttaaagggcgacatgagcatgatcgggccacgcccggaacggccagagttaacggaaaagttctataaacagtggccagaatttccgcaacgcttgcggattatcccggggattacaggttatgcccaagtaaatgggggctatgatatttccccagaagaaaagtgccacctagataattactatattgaaaactactcatttacctttgacgttaaaattgctttggagacgatcaaaacgatgttcacgggtgatggggcacgataaaaaagaatagatttgaagaaaacaggaagtaactttatgagtaacgatgaatttcctgctttttctgtactgatgtcggtttacaagaaggagaaaccggtatttttagataaagcattagagagcatcgaggatcaaactgttaaaccaaatcaaattgtggctgttgtggatggccccatagggagtgaactcgacgctgtccttaaagaacatcaaaatcaaaatacagatatctatacaattgtacgttcacggtactatcccctgtcaagttgacacttggcagattgctccggccaatatttattaaattcatcagccacccagcgcttcttgaccccggccctgcgccggcgggtgacggctttgtacacgattcaatacgatcaactaagcctgtcgcagcgaattcacgactacgtggcggcgaacctgcaagacctgctggcccccgggccccccgagctagtcagtgacctgttggcgacgctgcttactcaggtcttacggaccgtttttgaacggggggaattcccaacccccgccgaaatccgggcgctcaaggctgcctttgcccgtttactcaactaaaaagggtggtcaacattcaaaaataaagcaagaggccggaagaaaacgtggttttctcccggcctctcgtgggttaaggactagtagtccccgtttaaaattgagtttttaacgataacgtagtcgaccttggtgatcgattccaggtcgcgcccaccggcgtaagaaatcgctgactggaggtcttcttccatctccaccagggtgtcttcgatggcaccccggaacggcaccagcatttgcttaccttcgacgttgcggtaggcgcccttttggacttcggaggccgagccccagtattgcttgtagcgcttgccgtcaatcgtgatcaggttgcccggggattcttggtggccggccaacagcgagccaatcatcaccattgaggccccgaagcgaacggacttggcgatgtcgccgttgtggcggattcccccgtcggcgattaatggcttgcgggcggccttggaacacaggcgcagggcggcgagttgccagcccccggtcccgaaaccggtcttgagcttggtgatgcaagccttaccggggcccactccgaccttggtggcgtcggcgccggcgttttccaggtcgcgaacggcctccggggtggccacgttaccggcggttaagaaggtggtcggcagttgttgcttgatgtgtttaatcatggcgatcacgaaatcagaatgtccatgggcaacgtcgatcgtgatgtactccggcaccaattgttcgtcttttagttgattgataaagtcatactcgctgtccttgatcccgacggaaatcgaggcaaacagcccccggtcgtgcattcgcttaacgaagccggcccggtccgcggggttgaaacggtgcatgacgtagtagtagtcattttgggctaaccagaccgccaattcttcgttgattaccgaggccatgttagccggtacaacgggaatcttaaaggttttgggaccaaatttaacctgcgggtcagcttcctttctgctcttgatcacacacttgttagggatcagttgaatgtcatcataatcaaaagtttccatcgggatacctctcttaaaaagtgatttgaaaccgttagtaactataggcgaaaataagggcgccgtcaaggataaaaccgaacaattttacctaatgtcaggaaaaaggttcagaacaacccttgcaaatcacgaactgatccggtagtatcatagagtaactgtgcttaattttaagactaatgaggtgaacagaatggcaacagtagtaatcgtaggaagccaatggggagacgaaggaaaggggaagatgaccgactacctgagtcaagaagcgaacgttgttgtccgctcccaaggggggaacaacgccgggcacacgattgaattcgatcggcagaagtttgccctgcggctgattccgtccgggatcttcggtgaaaacaccaccgccgtgattggtaacggggttgtcattaacccgcaggccctgttggaagaaatcaagtacctgaccgaccgcggggtcgacatctctgggcttaagatttccagccgggcccaagtgatcatgccataccacctcttgctcgatgaatgccaagaaaaggctaagggcgccgctaagatcgggaccaccaagaaggggattgggccaacctacgtcgataaggtttcccggatcgggattcgggtggccgacctcttggaaaaggacacctttgcggcgaagctcaagcaaaacctggagattaaaaaccagctcttcaccaagatctacggggtcgacccggttgattttgatgaaatctttaaccaatactacgaatacggccaacaaatcaagcaatacgtcaccgatacttcgctactggttaacgacgccatcgaccgcggcgacaaggttctgtttgaaggggctcaggggacgatgttagacatcgatgaagggacctacccatacgttacttcctctaacccaacggccggtggggcgccaaccggggccggggttgggccgaacaagattgagaccgtggtcggaattgccaaggcctacacaacccgggtcggggaaggaccgttcccaaccgaattgaacgatgaaatcggcgactacatccgcgaaaccggtcacgaatacggcaccgtgaccggccgtccacggcgggttggctggtttgacgccgtggccatgcgccacgcccgccgggttaacgggatgacctacttgagtttgaacctgctcgatgttttgaccggcttgaagacgatcaagatcgcccgggcttacgaactcgacggtcaagaaattaattactacccggctagtttggcagaattagaccggtgcaccccgctttacgaagaggtgccgggctgggaagaagacatcacccaagtgaccgactacgaagacctgccggccaacgctaagcacttcttggaccggatcgtcgaactatcagagacgccactggccacgatttccgttggtccatcgcgggaacaaacgatcatcctccgcgacccgtggcggggttaaagtaaactaactgacaaaagagcgctggctgtctacttagacggtgggcgtttttttgttggctgcataaattggcagacggctagaccgtttgcgattttttattatctgacgataaaattattgttgatccaccagcggtgtttataaaattagtttgtgaaatttatggcagtgacgataaatttcacaagttaagttaagcggtacatagtgtgttaaatgttacttaatgaacaggatctaaaaatacttgtgaaatttgaaaaagcggttacaatgtgaagtgcagataacaaccaactaattattaaggaggcctactcatggcatatcaaactgttaatccttataccaatgaagttgaacacacttacgcagataccactccagaagaagtggagaaggcgttaagcctggcgcacggtctgtacttaaagtggcacgacggctctggtctggaagaacggaaagctgtgattacaaagctggggacgctccttcgcgaacgccgcacggaaatggctgaactgatgacccgtgacatggggaagttaatcggtgaagccgaaggtgaagttgacctttgtgcaagcttttgtgactactacgtagaacacgccaacgaattcctggcaccaaagccaatctacaccacttccgggaacgcctttatcttaaagcaatccctcggggtactgatggcggttgaaccatggaacttcccgttctaccaaatcgcccgggtctttatcccgaacttcatcgtcgggaacccgatgctgttaaaggacgctgctaactgcccaacctcggcccaagcctttgctgacttggtactggaagccggcgccccagaaggttctttgaccaacctctttgttagctacgaccaagtttccgaaatcatcgctgacccacgggttgccggggcctgcctgactggttccgaacgtggtggtcgttccgtggccacggaagccgctaagtccctgaagaagagcaccctggaactgggtgggaacgacgccttcgttgttttggaagacgccgacatggacaagctggccaaaatcctgccgcaaacccgtctgtacaacgctgggcaagtatgtacttcctccaagcgttacatcgttccggaaaagctggttccgcaatttgtgaacatcttaaaggacggcttctccaaggttaagatgggcgacccgttggaccgctccacgactttggctccgctttcctcgaagaaggccaaggaaaagctgacccaacaagttcaactggccatcgacaacggggctaagctcgaatacggctttgaaccagtggaagaccaagagggtcaattcttcatgccaaccatcctgaccggggtaacggtggaaaacccaatctttgaccaagaaatgttcggcccagtcgccgttatctacccgtacaagaccgaagaagaagccattgaaattgctaacaactctagctacggccttgggaacaccgtctttggtaccaacattgcccacgcccgtgaagtggcttccaagatcgaagccggcatgagctggatcaacgctggttgggcctccctgcctgaactcccatttggtggggttaagcactccggttacggtcgtgaattaagtgaaattggtttcaatgaattcgttaaccaacacctgatttacgaagtagaaccaaccgcttagtctttacctccctctcctcttaaatttatcggtgaaaatccccgtcaattccccagggacggggattttttgttgccaattttccaatttaaagttgggggagtcagaaaaaggttgagaagggcggccgagtgttgacatggtgccccgccccggttaagatagaaataataagcaatgcctttaagtggatcccgtgaggtcacaaggacggagaaattggttagcgccgccttggggactctggggggcgcttttgttatcagaaaaaggagtgttgatcgtggcccacgaaattgtggatggttcaagtatgcagcgtgccctaacccggattacctatgaaattattgagcaaaacaagggggtcgacaacttagtctttgtcggcattaagacccgcggcgtgtacttggcccagcgcctggccaagcggatggaacaactggaaggggtaaaggtccccgttggttccttagacattaccctctaccgtgatgaccgccaccagccggaccaccacgttgagcccacggtcaacgccaccgaggtcgacgtcgatatcaacgataagcacgtgatcctagttgacgacgttttgtacaccgggcggacggtccgggcggccttggatgccttaatggaccttggccggccgaagcgaatctctttggcggtcctggttgaccgtggtcaccgggaactgccgattcgccctgacttcgtggggaaaaacatcccgacgtccaatagcgaaacggttcacgtggcggtcgaagaatacgatggtcacgaagacatttcactggaaaaccgtaaataaaatcaccatttaagtaactccagcgagggtgcaagggtgaagtgggccgttagtgcggtgcctttttcatggcttctcccttcctgggggaagcctttttgtttaggaggaaaaagaaatgcaacgttttgaacccatggtcgccgtcgacgttgagaccaagcaagaggccctgcgcctgtttgacaagttatctagcgacaccgatcaccaaccaatcgttaaaatcgggatggaactgtactacgcctttggtcccgggatcgtccgcgaagccaagggccggggcttgaccgtctttttagacctgaagctttacgacatccctaacaccgtggaacggacgatgcgggtgcttggggccctgggcgctagctttgtgaccacccacgccgccggggggaccgaaatgatgaaggctgccaagcgcggtcttttggctggggcagcggcggcgggccggcgccagcccaagctgttggccgtcactaagttgacctcgattgacgaacagatcctccacgacgaacaaaaggtggccgggaccctgattgaggcggtgcaaaacgccgcccacctgacggaggcggccggtttggacggggtgatttgctcggcccaagaagtcgaagcgatccgccaggtaaccgggccggacttcttatgcgttacgccggggatccggttgaacctggataacaaggacgaccaaaagcgggtggtcacccccgcccaggcccgggaactggggagtaacgcgattgtggtcggccggccgatcaccttagccaaggacccgatgaaggcctacaatgaaattcgccaagactttatgggggaacaagactaatggagtttgaacaaaccgttgcaaacgacttgctgagaattagggccgtcaccctgcgccccgaccaccctttcacctgggctagtggtatcaaggcgccaatttacaccgataaccggctgacgatttcctacccggacgtgcgccaacacatttaccaagggatgagtgacctgattcgccgtttttacggtgaggcgacggtgatcgccgggaccgccacggccgggatcccccacgccgcttgggtggccgaagaattgggcttgccgatgatttacgtccgctccaagcccaaggaccacggtcagggccgccaaatcgaaggggtcttggtaccggacgccaaggtcgtggtaatcgacgacctgctgagcaccgggggttcggtactcaacgccgttaaagcggtccaagaagagggggctgaagtccttggcgtggtggcggacttctcctaccagttaccggctttagacgagaactttgcggccgccaacctgacctaccacacggtcaccaactacacgaccctgatcgaagtcgccgaacgcaatcacatggtgacttacgcccaaaaggattccctgcacgcctggcgcaaggacccggctaactggggttaataactaaggtgcattaactaccgcttaaaataagctttatacattttggcgctcccctcctatcctagagaaggaggggattttttccaatgcctttgacggctcgccggtggcgctagccctttctaaggtagtgggtcctaacttgagtcacttgtcctggggcttattattcgtgatcccgttggtaattgtgctcttggcgctcttgggaattcacccgctggtatcaattaccctgctgggacaagttctattgactagccaagtaacgatcccaaccttggcgattgcgttagccttaaacgtgggtggggcactgtcctacctggtctcaccattcgaaggggcgattgttttaattagcgacctggctgacgtcccgccgacaacggtggcaattaagtataatggttggtttggcctgtggttcttgttgctcagtaccgtggtgatctatttctttaccaattaaaggaaaataaaaaggcttcgcacccgaaaatgcgaagcctttatttattcttggatgttaggtaacgtgctagcccacggcccgtttcggaggttggtccgcttcccataacgtgctccccaaccacgggcctagtgcctaagtacgggcggagaacgatgcgtaccgcatcaacccccgccctagcttagtccaacggcccatttggaggttggtccgctcccccataacgtgctccccaaccacgggcctagtgcctaagtacgggcggagaacgatgcgtaccgcatcaacccccgccctagcttagttcaacggcccgtttggaggttgggtcgcacttcccccataacgtgctccccaaccgcagacctagtggctaagtctggtcacagaacaccgctgacgcgctaacctgtgccctatccttagcccacggcctgcttaataggctgggtcgcacttcctattctttaaggtatttattccgaattaacagctcccgcgacgcttgatcagcggggcgccaccctttatcaaagagccgttggaagtacagccggttgtagatcagggtgaaaattaacgaggaccaggggaagcccagcaaccaggggaggttaaagaccaggccgacgagggcaatgttggcagccgtgaccaggatcaaggcaaagttatagtaatccccccgaaacagggccgggagcgggccaaaccaaaaggtggtccaggagatgccaaccttagcgatccggatgtcgccggtatcgttggtgaccttggcgtagttaggtggggtcgggagattttttaaaaagtcttgattattattttggttgccaaatgggttttgcatggcgccctccttgttattcttagaccttaatcttatcataaacccgccgcgggccccaacaatcttccctccactgcaagggggtgggatccatgttagaatgaagccaactgccgttttgcgattaggaaggacgacgaaaatgctatttttctttaatgataatatccaagaaaacaaatccgggattgagcatgcccaaatcaagcggctaaatctctttaaaaaatttaaccagccggccaagattgtgattcgccagtactccaacgaattgcatcacgttaccaacgcggccggaattgacgatgccgacctggtcaacctcttcgattactttcaagaggcccgcctggtcaaggcgaagaaggtgaccttacaagacctaacctttgacccccgctggaagcgccgcgccgacggggttagttacaactactatgatggcgaccggcgggtgatttacgtgcgccgccaccagcgtgacaagcacgtgatgaacgttcaatactttgaccgcttcggcaagttggttaaggtcagttggtacgacaaccggggctttttgtcggtggaccagctctatgactggagcaaccagatcacggtccaaaactacttcaccccgacccaccggctggcgatgacgaccaccaccaccttagataagcggcaaaaggaaacgaccgtctaccacctttacgattaccaaggccaagaccttcagtttgcgaactttgacgagctgacccgcttcttttacgaccagatcgcaaacgaccgggagctgaccgggccgggcccagtcggctgcatcgtcgaccgctcctacgaactaggctgggcggttttgaacatgaaaacccgcatcttccgggtcctccagttacataacgaccacgttaacaacccggccgacatgcttcactcgccgttaaactacaactacgattggggcttgcgccacttgagtgagtgggacggggtgatcgccctgacgccgtcgcaacaagttgacgtcactgaccgcttcggtaaggtcgccaagaaggtttaccgggtgccgggggcgattgtgcccgatgaacgcctggccgccaagcacattccgatgaaaaagcgccaccgccatgaggtgatcgtgatcgcccgcctgtcgccggaaaagcaacaggaccaccttttagaggtctggccacagattctaaaggcggtgcccgacgcccagttaaacctgtggggttattccaacgacaacttcgaccaaaagctcaagcagatggttaaagacgagcacttggaaaagtcggttcacttccgcggttacacgaccgacgtgggtaaggttaacgacgaggcccaactaatggtgctgccgtccagcgccgagggcttgccgctgtccttagttgagggccaatcgcacgggctgccaatcgtggctaacgacattaaatacgggccgcgcgacatcatcgttgacggccaggacgggctcttaacccaaaacggcgataaagcggggctggccgcggcgatcatcgacctcttagaagatgatgacaagcgccaacggttcagcgaccaggcctaccaggacagcgagcgctattcggaggccaacgtgatgaagttgtggcaagaaatcattgacgacatgaacgagggggcggcaaaataatgaatttcttcgttaaccaatacctggtaactaaaaactcgagcattgaacacgccgaactaaagcggctggccctcttcaactgtcacgagcccgggtcggctaagctcttgacccaggactttgcaccgactttggatcagaccttagagcggtttggtttacagcgcgacgccgttattaacatgttcgacttttttgcgggcaccaccgactacgtgggggcgcccttaaaagtcgacggcctggcctatgacggcgacttgcagatggggaccgggaacaactttcgcgagttaaagcgcgggggccggctggtcagcgaggttcacttcattggcgggacggtcgcccgggtgggtaacgtcgattacttcgacgacgccggcaacctgaccctgcgccaaatctacgacctgcgcggtttcttggcggttaaccagtactacggccgggcgggcgaactcttttacgaacgctatcagcgcccggacggcaccgtttacctggagcgctactacgtccagtcaaccgaaaacacgccgatcaactcgctcaacgtcttaaaggactaccaggggcgcgaccgcttcttctatgaccaagagggactcttcaccttcttcttggacgaggttaaccgggcctttggcgaaaacaaccgcttctttgccgaccggccggccgtggcgatcaacccaattttgaacatgaccagcaaggtcaagcgttacttgtggctggcgatgcgggcggtggacgacggccaagacctagcaaccggtagcctagacacgatggtcgacgccgccttgcaacacggccgcaagtggaccggggtggtggttgccaccgcagcccaagccgccgacctgaagccgcgcctgccgaagggactcaagtgctacgtggttaataactccccggttaaagtcgaccgaacgccgatcttgattcaggaccggccggcccaacgcgtgattgccgtcgggcggctgggcgccgacaagcaaaccgaccagctaatcgacctcttcgcccgggttcacaccgtccggcctaaggcgaccctgaccttctacggttacggcaatcaagccgatatgcagtcctaccaggagcaagtcaaggcggccaacttggagcaggtggtcaccttcgccgattacgtggtcgacctcgagccggtgtacgaccaggccagcctgttggtggacgccagccgggtggacgcccagccgctggcgatggccgaggccctaagtcacggggtaccggtggtcagttacgattacgcctacgggccaagtgagctggttatcccgggccaaaccggagaactggtgccactgggcaaccgcgacgcctttgtgaaggccgtgatcgacttattgagcgacccaacgaagttgcaggacttcagcacggccgcctaccagaatttaaccccgtttagcgaagcgacgacttggcagcagtggcaagccctcaagtaggggcgccggacggttaaataaaaattatgaggaaattgttgacaaaaatgagaaagccattataattaagcgtaacaaattaatcgaacgctaaaacatatcgaaaagcagagtaatcgttagcggctagcaagagagtttccggttggtggaagggaacagcttaaggcggtgaagatgggcttggaatggcaccggcgatagttagttggtgacggagttgcacacgttatcagtgcagggtaattccttgaggagtaacccgctaaggctaccagccgtgaggtggtagcgaattaaggtggtaacgcgaagcactcgcccttgatcaatggatcggggcgggtgctttttttgatggttgacccgttcgagagacacaaagaaaaaacaaaaggggagcataattatgaagaataaaaattggattatctgggccgtcgtggctgtggtgattgtcgtgatcggttggttctcatttggtcacagttcgcaaaccagtagcaagacggttaccgtcggggtggttggtcaaaccagtcaggacgaagccatctggaaagaaattgccaaggtggccaaggacaagtacggggtcacggttaagctcaagaacttctccgattacaaccaaccaaacaaggccctgcaaaacggggatgtggatttgaacgccttccaacaccaggccttcttagacgcttggaacaaggctaacaaggggactttggtatcaattgggaagaccttcatcaccccaattcacctttactccaagaaggtgactgacgttaaggacctgccggacggggcaacgatcgccgtgccaaacgacgcctccaacgaatcccgggccctcttcttgctcaagaacgccggcttgattaccttaaagaccagcgccggttccttagcaacggttaaagacatccaggacaacccgaagaacttgaagatcaaagaagtcgccgctgaacaaacggcccggaccttagacgacgttgacgccgccgtggttaacaccaactacgccgtggccgctaagttaccggacagcgaaatcatctacacggaaccagttaacaaggactccgaacaatggattaacttgatcgccgctaagaagtctgacgccaacaaggaagcttacaaggacgttgttaaggcttaccacacgagccaagtgaagaaggttatccaaaaggaatacggtaacaaggaaattcctgcctgggacctgaagttaaagtaagaccacagaaagcgtgagggagaatatggcagacattatttcattagaccacattgatgtaaccttcccccaaaagaagggggaaccggtccgggccgtttcggacgtcaacttgcacgtcgaaaagggcgatatttacggggtggttggttactcgggggccgggaagtcgaccctggttcgaacgatcaacctcttgcaaaagcccaccgagggaacggtgaccgttggcggaacggtcttgtttaaagaccacgcccaacaagtcagcaatgccgaattacaggccaagcgccggaatatcggaatgatttttcaacacttcaacctgttgaacgaaacgacggtggtggacaatgtcttgtttgccctcaaacacgccaagctaaaggacaaggaggcccaagaaaaggccttgaacctgctggaactggttggcttaaaggacaaggcccaggccttcccggtacagctgtccgggggggaacagcaacgggtggcgattgcccgtgccctggctaacgacccggaaatcctgatttcagacgaagcgaccagcgccctggacccgcggacgaccaaccagatcttggacctcttgcgcgacttgaacaagaagctgggcttgacgatcgtcttgatcacccacgaaatggacgccgtcaagcgggtggccaacaagattgccgtcatgcaacacggggtgattatcgaacagggcagcctgcgcgacatttacctgcggccaaagcaggaactaacccgccagttcgtgggtggctccctggccgccatcgaaactttgaaggccttcaacctgggcaccctggccgcaaacgagcgcctctaccagctggtcttctcggccaagacggtcactaagtcgatcatcttggagctctaccggcaaagcggggtcgacgtttcgatgctctacggtaacattgaggtcttaggcgacgaaccggtcgggaccctctttgtgatcgtaaccggtgatgataatcaacaggccggcgcccttcagttcttgaaggataatcaggtggaagtaacgcaaattgatgatcgggggatttggaatgactagtttcttaacgcattacatgcccaacgtggttcaactcggctggaccggcgataccgggtggggaacgtcgatcgtccagaccctgtacatgaccttttggccggcaattttgggggggatcctggggttgatcttcggggtcgccctggtgattaccaagccgggcggcatcttagaaaacgccttttggtttggcctttgcgataaggtggtctccttattccgggcgatccccttcattatcttattggccttcattgcaccgttcacccagctgttagtcgggacccaaatcgggatgacggcggccctggtgccactgtcactcggggtctttcccttctttgcccggcaagtccaagtcgcccttgaatcggtcgacagcgggaaggtggaagcggcccaggccttgggtgctactaacaccgacatcatctttgacgtctacatccgcgaagcccgctccgaactggttcgggtctccacggtgaccctgatctcattgattggcctgaccgcgatggccggggccatcggggccgggggactggggaacaccgccatttcctacggttacaaccggttcaacaatgacgttaccctggtagccaccctcttagtcttgttgttagtcctgatcgtgcagttggtcggggactggttggcgcaacgccttaatcaccaggcacggtaaagggagtgcgaccaacctccttgacgagccgtatgactaagctaggggtttaatatttaaaatcgcatcggggccgggaaaaactaacttttctcggccccttttttcaatgggggaaattaatgatggatcaaatcgaacggacccgggtgcttagcaacctggtcaaaattaatagtgtcaacggcaatgaactagaagtggccaattacttgcgccgcctgtttgaacagcacgggttgacggccgacgtccagcccttcggcgagcagcgggccaacctgattgtagaggtgggcgccggtaaaccaatcctggggatcaccggccacatggacacggtcgccctgggcgatgaaaagaagtggcaccacgcccccctgagcgccacgattgaaggggaccgcctgtacggacgaggggccgccgacatgaagtcgggcctggccgcccaggtgattgccctgattgaattggttgaatcaggaaccctgactggtcatgtccgcttcatcgctacggctggtgaggagtacgggaccccgggtgctaaccgcctggaagaagcgggggtggctaaggacctgaacgccctggtggtcggggagcccaccagcgggaacgtcatctacgcccattcgggaagctacaactaccggatcgtttcaactggccaggcggtgcactcttcggaaccggaacgtggccaaaacgccctggagcccctggtcgactttgccctggccgaatgcgacctcttctttgacgttccggatgacccctgcctggggccgctcaagcactcggtgacgattattcaggggggcgagcaggtcaacacgattccggattacgcggagttgcgggggaacatccgccccacgatgcgcttcgataacgaccacgttaccgcccgtttgcaggccgccgtggaccgtcttaaccaggagggtgctgcccatttaaccctggaagtactccactcctggcgtccggtggcctccgatcccgacggtgactttgtcaagcgggccctgcaagctagccaggaggcctttgcaaagtacccgggacacgcgaccccggaactcggggtcatccacggggcgaccgacgcctcggtctttgtcaagcaccaccacgacctaccggtgattttactgggggctgacgactggaacatttcccaccaggtcaacgagtacaccaccctgtcctcctttgaggcaacgattgaagcatacaagcgcttgatcccggcctttttcgagtaacggcgagtggtcaccataaacaaaagccgggcaccacgcaatcttattgcgggtacccggctttttaataatattaattaaaccaacttggtccgccggcggtaaacgataaagcggcggaagatgtattgccacggcaaggttaaggcgtgcaccagccgagtgtacgggaagtaaccgaagacaaagaaaccaactaagacgtggatccggtaaatcaacggaacgtttaacattaactgccactgcgggttcagggtgaagaggctccgcacccacggcccgatcgattgacggtagttaaagtcaatgaaggcaccgtaaatcgtgcacgacatcccgagcgtgatcgtgatcaacaggacccagtcaactaaaatgtcgttgatgctcgaggtcttgtaaacccgggccacggtcatccgccgccaggttaagatcgccatcccgatccaagccaggctaccggccggaatccccatcatcagagaaccaaatatgtggtacatgtgttccgtgatgccgaagtaatcggtccaggcttggggaacgagcatccccaagatgtgaccaaagaaggccaggatgatcccaatgtgaaagaggatgctcccaatcatcagtttcttcttttcaaaaatttcactcgacttggccgtgatcgacccgtgaaagtacttaaaccgaatgaaggtcccgaagaaaaaggacgccaacatcaggtagggataatatacccacagcaggtgggcccaagcgttatgcatgtgcgttcgcctccgtttcaacgcaggaccggattaggccccgcaccgctttgattagtttcatgtacgggtcgtcggcgtcggctagggcgttttgcaagagggagtaggtcccgtcttcaatcactcccagggcgagcttgaggtcgtcttggcggctgtcgtccatgaagtcgccataggcaaagaactctaagagcatcggcaagtaatcagccagctcactggtcgtctccgccacgccgaacatttcgtacatcattttgagtttagcaaggatcgtcccccgctcgcgggagtcagtcatcttgtaataagacatgtaaagggtgtagcgccggttcatttcaaacaggctggcaaagtggctctcctggtccagcaaggttccttggtttaactcatcgaagagctcaccaaaggtcacttgttgctccttagatagcgccgggttttcgaccagggccgccctcatttccggactaaaggtctcctggtcgggataatcaatcaagcgcgacagggccacgaagacatcctggagctggttaatttttgcaaagttaatcacgccaaatccccccgtagaagctttctgcgtaaatttggttggttgattcaccagcttcggccttcttaaacatgctggagtgttgtggtgccaaggcacagccttcacattcatcgtaacccagggtcccctgttcggattgtgcgtcttcgaactgggacttgttggattgcggaatcacaaagcggtcttcgtacttagcgatcgccagtaggcggtacagtgaagtggccgagttttcggtcaagtcaaccttagccagcttagtggtatcgaagtcttgaccggccgtcttcgcccgcatgtaaagccgcatcatagccagcttgtaaagggcctgcttgatgaccggtacgttacccccggtcaaaaggttagccaggtattcaaccggcacccgcatctggtcaatacccgggaagatcatttccgggttcttcattgaatcccgtccttcaaagtaggacatcactggtgacagaggcggaatgtaccaaaccatcggcatcgtccggtattccgggtgcagcgggaaggcaatcttttcttcgaccgccatccggtagatcggtgacttttgggccgcttcgatcatttcctcagagatcccttcctttaaagcttggtcgacaatttccgggtcgttggggtccaagaagaggtccaattgggcttcgtaaagcttcgtttggtccggcgtggaagcggcttcttccacccggtcggcgtcgtagagcatcgccccgatgtagcggatccgaccgacacaagtttcggcacaaacggttggcaacccctcttcaatccgtgggtaacagaaggtacacttctcggccttgtgggtcttccagttgaagtacaccttcttatatgggcaaccggtcatgcaaaaacgccagccccggcaccgttcctggtcgaccaagacgatcccgtcttcgtcacgcttgtacatcgccccggacggacaagaagccacgcacggtgcgtttaagcagtgttcacacagccgcggtaaataaaccatgaaggcctgctcgaagttcttcttgatgtccgattcgatcttttgcatgttcgggtcctggttaacgtattccgttgaaccagccaggtcatcatcccagttcggtccggtggttaattccatatccaaaccagtgatttgcgactttggccgggccactggttggtgctttttctccgggccaaacagggtcttgtaatcgtaggtccatggctcgtagtagttgtctaattcgggcatgtcgttgttgtaaaagatcttccccagggcgatcttgttcaacttgtttccggcctttaactccaattttcccttggaatttaaggtccagcccccgtggtattgttcttcgtcttcccagcgcttagggtacccgaccccgggcttggtttcgacgttgttaaaccacatgtattcggccccgggccggttggtccaggtgtttttgcaggttaccgaacaggtatgacaaccaatacacttatcaaggtttaagaccatcccgatttgtgctttaatcttcattccagttcaccttctttaactttcttacgttcgcgtataggtcccgctggttcccggttgggccgtagtagttccaaccgtatgacaactgaccgtagccgccgaccatgtgggtaggcttaacgtggatctgggttggggcgttgtgcgagcccccccggttcccggtgatcgttgacagcggttcgtagatttcattgtcctgggcgtggtacatgtacaaggaacccttaggcatccggtgggaaaccaccgcccgggcggtaacgaccccgttccggttataaagttcaatccagtcgttgtccttgacgtcaattgcctcggcgtcttgcgggctcatccaaacggttgggccaccccggaagagggtcagcatttccaggttatcgtagtacatggtgtggatgttccacttcccgtgcggggtcatgtaacgaagggtgacttccttgtcggcaggggtgacctcaacgtcaccaggtcccatcacttgtggtggcaaggacggcttaaaggtcgccaacccttccccgaagtcgaggaagatttcgtgatccaagtagaattgttgacgcccagtcagggtttcccacggttggaggcgttcgacgttcaaggagaaggccgagtaacggtcaccgttgtgcttagcagaggtcccgattggggttgggtaagcctcttgcggctgggcggtgatgtttttaaaggtcatcttggcttcggcgcggccacggccaatgtcggttaacttttcaccagaggcctgttcccgctttttccaccctaggtcagctaagcgcccgttggaggccgtcgacatccgcaagacggcgtcacagaccttggtgtcttcgtctagcattggtaagccagcgttgtagccatcggtgtaggtccctagctcatccttaagctcttcaatttctggggtgacgtcatagccgtagttagcggccatgcttgggcccagggaaacgtactggtcgtagatgtggtggtagttacgttccactaaagacattgacggcattgtcttgcccggaattggctcgcattcgcccttcttccagtccttgatttggcccagtggctggctgatttcacccggcgtcccgtggcccagtggctgggtctttaagtcgtaaccagtttccggtaggtacttcttggccatttgggtaaaggtcttagccaagagcttaaactgttgccaatcggagcgtgattcccacatcggactgatcgccttgttgaacgggtgaatgtaagggtgcatgtcggttgacgacaggtcctctttttcgtaccaggttgccgccggtaagaccacgtcggagtacatagccgtcgaaaccatccggaagtccatgtcgacaaccaggtcaagcttcccagtcgtgtcctcgtcgtgccagaccattgacttgggcttcaagcgggtgttggccctggccaagagcccattttcggcacccaggaggtgcttcatgaagtactcagcccccttcccagaggaggcaaacaggttggaacgccacaagaagaagttcttcggctggttttgcttggcgtctgggtcctcggcggcgaagtgcagggtgccggccttgagctcttccaccacccgcttttgaatttccttaatgtctttggtttggtaatcatcgacaaaggacagggagctgcggtcaaattgcgggtaagacggcagccaaccgaggcggattgccatttgaacgtaatcggcgttgtttaggtaacggtggtcaccctgataaaccggcgagtactgttgctggttttccatttcctcgtaacgccattggtcggtggcaaagtagtaccaagtcgtcccctgttgttggcgggcaccacccttgtgccagtcgttggcaaaggtgatgttggcccacccttcttggggccggagcttttcttggccgacgtagtgcgcccagccgccaccttgcaccccgatgcaaccacacaacatcagcatgttgatgatcgcccggtagttcatgtcggcgttaaaccagtggttaaccccaccacccatgataaccattgactttccgccggtatcgagggcattttgggcaaattcacgggcgatctgggtaactagttccggcttgacgccggtatattgttcttgccaggccggcgtgaagaaggagttggcgtcgttttcgtcttgggcggccagttcgtcgcccgcccgacgcttaaccccgtattgggcgagcatcaggtcgtaaaccgtggtcaggtagtgggtcgaaccatcggcaaaggttacctcttggaccggaatgtgacgtgccacgaccgaattaccttcgttagaaaaggacgggaagtcaattacaacttctttagttggcgttacctggtcttcaacagacaacgccggatcaatggcgttgccagcggcgtcctttaattctaggttccactgggtgccttgatcgtaatcctgtcccagggtcccgttcggcacaacgtagcggttggatttggtgtcgtaaaccaccgtcttccaatcggcgttggtcacggcgtcgtttgtcaaatcgttgattcgcacgtagcgtcccgaagttaggtggtcattgccggccgccgaaggaattaattcaaccataaacggcaggtcggagtactgcttggagtagttaatgaaggcctgctcgtggcgcttttggtagaattcgtttaggatcacgtaggtcatcccctgagcgacggccgagtcgctccccggttccggtgccaaccagtcgtcggcaaacttaacgttttcggcgtaatccgggctgacggcgacgatcttggtccccttgtagcgaacttcggtcataaagtgggcatccggggtccgggttaacggaatgttggaaccccacataatgatgtaagaagagttgtaccagtcggctgattccggcacgtcggtttgttccccccaaacctgtggggaagcaggcggtaggtcggcataccaatcgtaaaaggacatcacttcgccccccagcagggataagaagcgcaccccggccccaaacgagatcattgacatggccgggatcggggtaaagccggcgatccggtcgggtccgtaatttttaatcgtgtagatcaaggaagccgaaatcaattcgagggcctcggcacggtgaacacggaccattcccccgtgcccccgggccgacttgtattccttggccttttgtggatcttcgacaattgaggcccacgcgtcaatcgggctttcgtggttttgcttggcgtcttgccacatcttccacagccggccccgaatgtatgggtatttgatccgcaccgggctgtactcataccatgagaagctggccccccgcggacaaccccgcggctcgtaacccgggatgtttggcccacacgatgggtagtcggtggcctggtgttcccaggtaatgaccccttgcttgacgtaaacgttccagctacaagaaccggtacagttaaccccgtgggtcgtccgaacaaccttgtcgtgggcccagcgctgccggtaaagcttttcccagcgccgtgagttttcttctagctgggtgaaggtaccgttgaacttttcaaccttgtgaaaaaaacgtgacttaatcactgttatccctcctaaaaatgtacttggcccactagtgcttaataaagtaagccatttccctaataccaacactagcacccaaattgctatactacgactagggaaagtcctatatttttaataaaggaggcggaaaccatcgaccgatacgaccgccaacgccgggtgacttccatcggagcagccggtcaagaaaaaattagccaagccaccgtcttagtggctggttgcggcgccttgggttcttacgttgccgagcaactcacccgggccggcgtcgcccacctgattttagttgatcccgatcaggtgtcattaaccaacttacaacgccaggccctctttgatgaagacgacgttaatcaacaccgtctcaaagtgatggccgctaaaaaccaccttaaccaaattaaccacgaggtcgaaattacgccgctgccggccccactctcgattgacttactcaacgagttagattttgacctcgtcattgactgtttggataactaccaggcccgtgacctgatcaaccaagcggcctgggtccatcagttttcttatgtctttggctcctgcgccggcaacttcggtaacgttatgttaattgacccgagcaaggggccttgtttaaacgacgttttcccggatttagaggcgctcaaggccaccgattgcgacttaatcggggtcaccaccccgttggtaccgctggtggcggccaaccaggtcagcctggccctccactacctagtcgacccggcgacggttaactatgaccgcctgttaacaattgacgcttggaacggcgacttcaactacttccgcgtccaaaagcgaccggattgcccagtttgcgccaatcacaagctaacggttgaaccagacgtcagcccgcaagtccgcgtcctgtgcggtagccaaacctacctaatggacctaaccgaacgtcttgatttaaatgacctcgccgactggttaacggatcgccaaatcgaagtcgaacaaagccccaagttcatccactttacctttaaccaaaacgaactatccgcctttaaaaacggccgtttgatcctctacggggcccccgacctggcggacgccgaaaatcaattcgaccgctttttagccgtcaccaaccacttaatgacccagtagaaaggagcagatagtagtaccatgttaacagccaccattttaaccgtctctgacagccggcacctggcagaagacgggagcggcgccttaatcaaggcccgcttgctagaaaatgacgttacggttattgaccaccggatcgttgtcgatgaccaagttcaaatccaagcagcctacttaagccaagaattgatgggcgccgacctgttaatcatcaacggcggaaccggggttgcccaacgcgacgttaccatccccgccatcaccccgctcttaacccagcaaattccgggctttggcgaggccttccgggcgctttccttcaaagagattggcacccgggccctggcctcccacgccatcgccggtttcaacctgtacaaccagttgacttactgcctaccgggctccaaaaatgcctgccaaacggccctcgatcagctgattttgcccgaactccagcacttaatttttgaacgcagcaaccaaagaaaggatcttcaccaccatgctcactagacgaacccccatttccattgcccaagcccaagccaagatagccgccgtccccctgaaattaaccaccgaagaaattccggtcaccgaggctaaccaccggatcctggctaagccggcccaagcggcctatgactacccccacttccgtcgctcgggggtcgatgggtacgccatcttagcggaagacgaccacgactttccgcgcgactttgaggtggtggccgaagtgcccgccggggccgtctttgacaagcaacttcaaccgggccaaactgtccggatcatgaccggggcctgcgttcccgacgaagccagcaaggtgattatgatcgaaaagacccgtgataagggtgacgaccaagttaccatgatggcgaccgaaaagcacagcaacatcaccgaagtggggaccgactttgcgaagggccaagaagtaatggcggctccccaagaaattaacccgggtggaattgccgtcctcaccgcctttggtatccaaacggtgaccgtctacaagcagccacggatcgccatcatcgccaccgggactgaactgctggcccccaacgccccgattgaaaagggaaagatttacaattccaacgggccaatgctcaagcgcctggtcgaagaaaccggtggggtcgttgacgaagaggttcaattacccgacgacgatgaccaaattcaagtggcccttgaagaagcgatcgctagccacgaaatcgtgatcaccgacggcggggtctcggtcggtgactacgacttcattggcgacgccgctcgcaatgccgatgaaatgctctttaacaaggtcaagcaacgccccggtagcgtcacgaccgccttcgttcaagacggcaccctggtgatggccctctccggcaacccgggcgcttgcttcaccggcttttacctctacatggaaccgctgattcgccgctaccaaggaatggacagccgggtcaaaaaggttactgggatcttaaacgccccttacaccaagaccaacggctttgaccggatcctgcgttcgacctacgaacaaaaagacggcacctactacgtctacccgaacggaactgaccgctccggatccttggccaacctgcaaaccaccacttgcttctgcacgatcccgcactcaacggaaccaatcgctttacacagtgaggttgaaacatggctcttaccattcaagtagtcggccacaaaaagactggtaagaccttggtcaccgccggcttaattaagcgtctgaccagggccggtttatccgttgcagccatcaagcacgacgcccacgacggcaacattgaccaacccggcaccgacagcgatcgcctttaccaagccggggccaaccaggtggtcttccagtcacgccaagggagttttcaacgctcccgcactccccagccactcgccgacctcgtggaccagttccagcaaacggccgacgtagtggtaattgaaggccataaagcggcgcattaccccaagttgattttactggcgccgggggaaagccgaagcgattgggcgggttttaacgccttagcctttggcgccttagctcaacaagccggcgccgatttaattggggccccaaccatcaccgactggctctttaactacgtcattacccattaccaaaaagaggaaactcagatgtctgatccattaacccacttcaacgaccaaaaccgggccaagatggtcgacgtcaccgctaaacaagtgaccgcccgcaccgccacggccaccggcacgattcggatgcaacccgccaccctcgaccggattcacgccgggacgatgaaaaaaggggacgtactcgccgtgtcccaagtggccgggatcatggccgctaagcaaaccagcaatctaatcccgatgtgtcacctgatccccttaaccggagtcgatatccactttacagacaacaaccaagacacgattacggccacggctaccgtcaaaaccaagcatgttaccggagtcgaaattgaggccctcttggccgttcagaccaccctcttgacgatctacgacatgtgtaaggcgatcgaccgcgggatggtcatcgacaacgttcacctggtcgaaaaagacggcggtaagtcggggcacttccaatttggggaagccccggagagccaagcatgatcggcctggtcttagccggtggtcaatcgcgtcgcttcggggttgacaaggcgacctacgccttgcccggtcaccccgccaacgtggtgagcgccgtcaaacgacttttgcccctgtgtgaacaagtaatcgtggtggccaaccccgccaaccagaggcagatccaagccttggtgggtgaccgggccaccgtaattttggacccggaaccgtttcttggtgaaggaccagtggccgggatcctggccgcctgccaaagcggggccaaggagcttttgctctccccctgcgactacccaaacctgaccacccaatcaatgcgggtgttagctgggcaaccaatgcgctatttacaagtagccggcaagaaccactacaccttggcccactttcaaaccgatcaagaaacggtacaagcttggttatctggcggtcagcggcgcttgcaagacttcttaaaaggggcgttacactgtcaaccactggtaattaatgccgatcccaaagaatttactaactataaccaaaggagttccgtataatgaaaactatgcaagaaatggcgcctgccgatttccaaaagctgattgccctagtcttagccgacttaaccattcggcggaccttgttagaaaaccgggaacaagaagtgaaccaggaaatgcggtccctagaaaaggacgccgaactagaggacctggataaccaaattcaagccatccaggccgactatcaccactaccgggacttcgttgatcccaactttaaaattgacctagatcaatactaccggggaatgaaataaataacattattctttttggaatatttgcatattctaaacctcagggtataatatggaggaaagattatgaccgcaggacaaccgcaaccactgcaaacataccaggagttagttaaccgcttgtaccaacaaagtaactatgactttgttggcgtagcgctacaagctcccgttagtccccacctcacccggtggctatttgtggcgggcaaccaaaacgaacggttccggcgaattgttttgcgacgcgggattgggattgccggcctcgtattacgaactggcgcccccttttggcataacgatattttagcccttgatctgagcgaccgcctttattcccccattgcccgagctgaaaaccttcaagccgtcgtggcggtcccgattaatgacgggccgttgcacacggttagtggggtcctactcgcggggtaccatagcggccaccaccgggtttgtgaggccgatgccgacaagttgtctcaatccctggcctaacccaaggatggaggcgacttttttgttagaaacagcaaactggatccaaaccttttttgacttatcatcggacgcaaccttcattttccaggccgatcaactggtagtcgctaaccaggccggccaagacttgatcgacgcctttgacctggacctcgactacttacaagaactcgcccacaccgctattgctcagcaacagtcaaaggcggacgggtgctatgattgtgaaattatgaaccagctccccgaattgaccgtgcccgttgacctaccaccggatcacactaatccgttgcgctacaccatggtttaccgggttctctcccccacggaccaggtctacgctctggaattaaagagccgggcaaccctcgaccgggcgacccaagtagctcaacagcggatgttgaaccaatacgtcaaccgggcctatgaagatgagcgtaaacgaatttcccaggacctccacgacagcattgcccagggggtctattcggcgattatgggggtgcgtcgtttaaaaagcgagcaacttgatgaacccgaacgccaacaggttagcaccatgatcgagacccaacttgacgacaccctacgtgaagttaaagaaatggccctagacatccggccgtccgttctggactcctttggcttggtagcggctatccgcgccttagccaagcgcttgaccgagaactcgggggtcatcatcgacgtaatcggcaaggctgacaccagtggcctgactaccgacgtccaaagcgtcctctaccggatcactcaagaggcgatcaataacgccctcaagcacgctaacccaaccgaaattacggtcatgctcgtcgcccacgcccactatatcagcttggaagtgattgataacggctgtggctttgattttcaagcccaccgtggctttaacggtcactccctgggcctaatgaacatgagcgaacgggtcaaggctttaaacgggtcctttatgattgactcggcacccggccaggggacaacggtgaccgtcaagttcccggtcattgaaatcaaccaccaagtaaacggggaatcgtagtatgtacaatgtattaatcgctgatgaccacgccatcgtgcgctctggtatcgcctacctaatcgataagcaaccaactttccaagtggttggccaaaccgctaacgggactgacacctacatgcgggttgaacaaggcgacatcgacatcttgatcatggacctctccatgccgccgggtgaaagcggcctgatcaccgcccaacggattcacgaacactaccccctggtccggatgatcatcctctcgatgcacgaggaacaagagtacattaacaaggccattcataacggcgccatgtcatacgttttaaagagctcgccggattccgaaatcttgcgcgccctaacccaggtctctaacggggaaaactacattgatgaaaacatcaccctgaccaaaaaggacctttcccaaattaatttcgatggtgttgacgtcaatttgaccggttataattccctttccaaacgtgaacgagaggtcttcccgttagtggcgctgggctacaccaataaagagattgccgctaagctcttcatttccaccaagaccgttgaggcccacaaggccaatatcgtccgtaagcttaagctcgaaacccgagctgacctggttcgctacgccattcaccaccacctaattgatatctaggctagtcaaggggctaggagaaagtaggttttctccccgtcccttttaattttccgttttttaggcaagcccccaatggtttttggactaactactgcctaaaattagcataaagaaccttattcgggaggaatttattatggccactaatttatcaagagatgatgaactgcggggaatcttaagtgacattacccgtcaccgtttcccatcacggcgccaactcaacccccagtccaacctctttttaaccgctaagtacgccgttgaggagggctacgtcacccacgctactttagacgaaagtgaaagccaatccctagccaccctcgacctaaccgaagccaccttaacggccgccggggtcgataagctggcggaactcaaccaactggaccaataggaggaacccatggacgcccaagaacagctcaaccgtaagtacaccaactcatcgatttacacctcggccttttacgccgaccccgatgacgccttagacaaccgcgccaaactctttgaggggctcaagtcctttaccatgaaccaacacgaggactcgcccttttgcttgcaagtgatgtcgaccaacagcgaaatcaacgtcatgcccctggggttgttggacctagaagaactcaagaattacgaacaagaacaacgccgggccaaggggctctttcaggccggtgacgaaatccccctggtagtcaaatacatcccccacgttaaagacgaagaggttaagcaaacggtcgtcaccactacccaagagctcttcgccgactttaacaccgccttcccaaaggtctgggcggccgttaacgattacttgcgggataaccaagccctgctaaacgccattgaagcggacctggtcgccgactttgccgacgtttaccgggagtaccaagctaactttacccagatgagtgccagtgaacgacaaaaggcgcttggttttgaactcaaggacgaagaactcgatcactttgcccgctttatggccgacatgcacgaggtccaagcagtgatcttctcggcggccggtttcgttaaaaaggagttagttggcgaaaataccttccaagaagtcatgaacgacaacatccgccgttccaccttcttttgggttctcgataacaccttttacgaggtcctttactacttcttgactcactacggccaggaaaacgccaagttggctaagcacctacgccaccaaaaggcgaccctcatttccaacatgcgcaacgacgccttcgaacgggcccaaaaagagctcagcgccgttgatgcaaccaccgattttgaaaagtacttcaccgacgtttacatcccggtcgccgaacaactggccgccgaggtggacaagtttaacgggggcaccaaatgaaatttccgcaccacgaagagctaaccgaggggttgggaaccctagttggccaactaccgccgctgattaaagagttgctcgacccaagtgtcgacgccaccgaccgcgacttgcgcctgcacctcttcgcccttttaacaaccggtcgggagctgacaatggaccaggtccaagccgcttgcttacccgaatttttggccctcgggatgagtatgaatcccgcctcctttaacccaagccaaaccacccccggtgacttagcccagcaaaaggcgcggacctacctcttcccctacctgatgaatcgctacctagcgggattgcgtttgattaatacccccgccgccctgctaagtgagtttgaagtcgacgccggggacctagcaatcgcccaacttcaacggttacagtacaactacaacgcccacttcaaggttgccaactacctagccgatctgaaggcgcggactgggctactagcttccttaactgcccgccacgccatggccagcgttactaaatcagcagaggtcatcggcttagcggggcaaattggtcagtccttagcggtggccgcccacatcattgatgagtgtgatcagttgactacccctacttacttcacagagcggatcgtgaccgggacctacccgctagccctcttgttcacccgggaaagggaagccacgtggctcgatcagttcttcgcccaaccccaccggcccagcgaagcagacttcgcccgggccgctcagctaacgattgacaacggacgtggtcccgccctggagatggccggcgaattactcagccaaacccagctcgacgtccaagtcttaccagtgggtccggctaaggatgggctcagtcagttcattacccaagtgaccaatgatataaaatcggaatattagataattggggatttggaataaaaatatactgattttgcagtaaaaactcgttataataaacttcactgactttagtcagtggtggttgacccaaattgcatgccaccgtttttgacggcgctactcgggaggcccttcacagcctcctttttatattgtcattatggcacggcgatcggggcggtcaactagctacccttttaaaagccaaagcggggacgtttcctgatggttacgttcccgcttttttgtaaacaaccagcaggcctgcggttgtttgccactctctttttacttgttgttaaacggcacggcgttttccttggtgatcttggtgatgccgtggaagtacggtaccaagacttctggaatcgtcacggagccgtcttcgttttggtagttttctaagatggccgccaacgtccgcccaacggctaaaccagaaccgttcagggtgtgcacgtattggagcttaccgttttcgtcccggtattgcatgtgcaggcgccgggcttggaagtccaagcagttggagcaagaggaaacttcccggtacttattttgggccggcatccacagttccaggtcgtgggtttcggaggccgtgaagctcatgtccgaagtcgtcaaggtgatgacgtggtacggcaggccgagcttttggaggatgttttcggcgttggccgtcatcttgtcgagttcttcccaggattgatcttgcttggtgtacttaaccatttcgaccttgttgaattggtgcatccggatcaacccgcgggtatcacgaccagctgacccagcttcggaacggaagctaggcgtcaaggccgtcacgtaaaccggcagcttttctgcggggatcacttcgccggcaaagtagttggtcaacggaacttcggcggtcgggatcagggtcatgtcttcgccgttcacttggtaaacgtcctgcttaaacttcgggaattgaccggtcccgtacatcgcgtgagcattgacgatgtacggcggcaagacttcggtgtagccttccttcatgtgttcatcgagcatgaagttgtacagcgcccgttctaattgagccccgaggccgacgtagtagacgaagcgggagccagaaaccttaccggcccgttcaaagtccaaaatcccgaggttttcgccgatttcccagtggtgctttggttcaaagtcgaattgacgggcttgacctaccttacgcagttcttcggccccatcttcggtcaggctaaccggcaccccttcgtgagggacgttcggcaggtgggctaacttgtcaaagaggtccttgtcgtttgcttccacctgttcgtctaaggccttgatgtcttcgccgacttggcgcatctcggcaattgcttcgtcagcggattgcttggcccgcttagcttccccgatcttcttggaggcttcgttacgcttggccttcagggtttcggttcgttgcaggagttcgcgccgcttggcgtccagttccagcacggcgtcgatttcttctggttgaacgccccgggtggccagcttttctttgaaccagtccggttgttggcgaatttgcttgatgtctaacattgaaattcctccttatgaatgcaaaagagccacccgttccacagttgggacgaaatggctcttgttccgcggtaccacccaagtttgctgaaatcagcacgctctatggtgaataacggccaccagaccgtgcggcattacccgcccacattgatggtgccggagtttcggaagctggcttccaccacccgccagctctcttggttcctacttgaagcaccccgtgttttgaaattacagccattttaatatagtcgctcgtccttggcaactatttcccgggaaattagtccgttgccaggtgatatttaaccttgctgcgcccattctccgcgatcacctgtaactgatcggggatctgctcctccagctcggtcacgtggctgatgatcccaatcattcggttgccgtccaggctttgcaaggtatccagggcttcacccagggcgtcttgatctagggagccgaacccttcgtcaacgaagagggcttcgatttcaacgcccccatggtggcgctgaacgacttccccgagggccaacgccagcgccagggcggtcaagaagctctcaccccccgacaggctttgcaccttgcgcgctttgccggcgtagtcatcgtcggtgtaaatttccaacccgtttttgttctgccgccccttaaagtcggcttccccatccaggtgcatttggtagcgaccgtgggttaacttagctagccactggttagcgaccgccaagacctcggtaaagtagtggcgttggacataccgctgcaagcctaactgggtcccgccctgccccttgagtagggcgcacaggctggaaagttcccgcagttggcgctcggtgtcgccctgcttagccgcctttttttcgacttgttgtttaatttccttgatccgcgtcagggcgttgccttgttcaatcaccgcccctttgagctggtccaacttcacctgggctttcttcaactgccccgccgtcttttccacgtccggcttgggccggccggcgatttgttccaccaaccgttggcgctggtcggccaggctcgccagccgttgacggtagtcgttgacctccctttggcgggccgccagttccggaacgcgggccagggcccgttcaaagacctcccacgctgcttggcgttctgctagggccgccgttagttcccgcttgcgttggtccacttcggctgcggtcgctttggcgctgtccgctagctgctggctcgtggtggtcagttgggttaattgggtttgggcccgactaagggcgtcctggttttgcgtttgctggctggcaaagtccgctaacgcctgttcctcttcctttagccaccgctcggcactcgccaggtccggcagttcggcgggcaactggccctgcttgttaactaactcggtttgggtttggttgacgttcaggcgcccttcattgaccgctgcttgcagttcctggtactttgcttgccccgcctggatctgcttggtcaggcttacctggcgttgctggttttccgtttccttagcttgggcgttttgcaattcctggcggtcgcgatccaacgccgcaacggcttcggccacggccgccgtggctgcctccaggtcacccgctgggcttgccacggcttggcaaagcgttgccaattcgtcttggaaagttgcccgtcccttttctagctggctgtcttggttcgcttgccgcgtggttaaagtcgccagggtcgtttccgccttggtcactttcgcctgggccgcatctagcgttacctcggttacttcctggcccgtttgcaccgccgtggcgacgtgggggtgggtggtactcccgcaaatcgggcaggcctccccttcctccagctcgctagccagggttgcaatcatggcggcgaggcgggccttcttcttttctttaaggtccgcttgagcggcttgggcggtttttttagcctcggcaagctgagcgtttaggtcacgcagggcttgctcctggttggccagctccttggcttgctccccgagggcggtcactacctgttgccagcggactacttgttggaccctggtggcaatcgtaaccgccacttgggtcaggtcgggagcggcttggagttcctgatccacccggtctaactcggcctgtaacttagtcagggcgctcgtttggtcactaaccgtccgttcttgttcaacttgggcccggcgctctttttccagccgcttacttagggcggccacctcttcaaagagggggagcttctctcgaatgttggccacttggcgttggcgttcttggacggccggttcttgttcctttaaccgttcggccacttgggtcaattcttgcacccgcaccttaaccgcggcttgtttttgttcacacgccgcttgctgcttggtgaggtccgccaatttggtcgtcccggcttgccactcgtggtaggccgtttggtgttgttgggcccacaccgtttcttcgttttcgtcggccaagcgtttaatttgcggcgcccgttcttttagctccacttgttgcgtttcacaggaaactaacgcagcgtggtcctcggccaagcgccgttccgcggtcaactgggcttgcaactggtcggccgctttttgtgccgtggttacttgttcggtaaccgcccttagctccgcctttttttcggtcagcaggtccccgaccgccacttgccactggtcgagctctagctggtcgctaaccccgtcaacttggcccatcaggaccttgagctgactggtgatgtcttgggtttgatcacgcatacttttggcgcgctcatccagcttcgtgacccagttggtgtagagctgggtttgaaagagggtggtgaggatctcttctttggtcttggaatccgccattaaaaagcgttgcacctcgccctggggcaggatgatcagctggcggaactgactggcgttgacccccaaaaggtcctgaacgaactgattgacctcggtgatcttcgtcaactcacgggggttttcagcgccaactgggtacactagcgaaacctttgggtcgtattgcttttcccccttgccccgggtcatcgtcaggacttgccgtggccgccggtagacttggtaggtgacccccttatgttcaaataggaaggttacctcggtcacctgcttgggggtcgcaaagtcggagcgaaacatttcggccgaccggcgctcgttggaggcgttgccgtacagggccacgcacatggcgtcaaagatggtcgtcttcccgctcccggtgtcgccggcaatcaggtataacgggctagcgtcaaacctggtgaagtcaatcgtggtgtcttcgtacggcccaaagtagtgcatcgttaacttgagtggtttcatccttcctcctccttttgggctgctagcagggcgtctttggcccactggcgctggttatcgcttaactcttcgccggtcacctggtggtaaaagtcactcaacagggccagcggatccttgttttccaagtcctgcgcgggcgccgctagatcactctggtcagcggccttgttcacccggctaagggcaatgattttagggtagtagtggcgcagcttgttcatcaaatctgggatcggcgccgtatcggtcaactcaattacaaaaaagtcgtcctcctggtagtggctggcgtactccaccgttgccagttcgtcaaaggagccggttagcttcactaggtcgtggagcggctctaaggggacccactgaaggttaaagggctgggtgtcaacgatccagacgcccttatcgaggttgacctcgctcgccgaaaacttgagcggtgatccggcgtacttaacccgcggtgcttgaagggcgtttttattgtgcaagtggcccaacgccacgtaatcaaagggtgccatcaggtcaaccggtaccgcatcgaggccccccacctcggtttgggtttccgaatcggtgtggctggatccggccgcaaagaagtgggccaccaagacgtgggcgcggtccgggtcaaattcttcttctatcttagtcacgatccgggccattgccgttttcaaatccctgatctccgggtcaccaaagtaattacgtacctcctggaggccaaaaaagggcagcaagaagaactgggtgtcgcccagggtgaccggctcttcgatggcctgggcgaccgtggtgtgcataaagaagttggtcgccttaaaccagtcccccccggtggctaaacggaccgccgaatcgtggttgcccgagaccgccaagagtggccaaccttccttaagattcatttgaattaagtctttgtttaactcttcgaccgcctcttcgcttggaactgagcggtcgtaaaggtccccggcgaccaccacggcatcaactttataatcctttgctaattgattaatttttaagaaggcgtcgtgctgttcggccagtaaatcgaacccattcaactttttaccaacgtgccaatcggcagtgtgtagaaacctcattcgttccccctcctctgaacatgtgtttgtttaattattttaaacttccttccggggctggtcaacgcttggtagcttggtcttagtttacaatctttactcatcacgctaaaattgagttaagtttatattttaaccacaatttaagtattttttattcaaagatagagtaaaattaagccttggttaacccagaacaatacccagaaaggagcaccgctgaccatgctgaaggatcatcctgcggtggcgttttgtttgcgaacgcttttttattttgctgtcttgatggtgctgatctacatgtacggctactttggggccggacaagctccgtttatctacaatgagttctaaaaggagtaattacattggtacaaaacattattcaagaaattgaccggatcgcccaagcgcaaccggacttccccgccttcgatgagctggggactatccactcctacggcgatctttaccactactctaatgcgctagcggcgtggttagaccaacaaaacttacccgctaacagcccaattttgatttacggtgaccaccagtttgaaatgatggcttccttcatcggttgcttaaaggccggtcacgcctacatcccggtggaaaccgattcggccctgccgcgggtcaagtccatcttaacgaccgccgcaccgcaaatggtgctggccgtcgatgacttcccggctgacgaacttgactttgctggcaccgtggtcaaccacgaccagttagtcgacctgctccaccaagaagtcgactatcaactggatcacttcgttgacggcgacgacctgttttacatcctcttcacgtccgggacgaccgggtcacccaagggggttgaaatcacccacaccaacatctgctcctttgccagttggatggtgtctgacgccttcaacctcccccacaaccaaaccttcctcggccaaccgccgttttcctttgacctatcgaacatgtactggctaccagcgctgttgaccgggtcaacgatcaaggccctgccacggacggtggtccaaaactttggccaactctttacggtcgtgccaaagttaggcgtttcggtttacgtttcgaccccgtcctttgtcgacatgctcttgttgtccccggacttcaaccaagagaagatgccggaactcaagtacttcctcttctgcggggaagaactgaccgtttcgacggccaagcgcttgtttacaaacttcccggacgcccatatctttaacacttacgggccaaccgaagcggccgtcgccattaccagcgtggaaatcaccaaggaaatggttgctacggccaagcgcctgccgatcggctacgacaagcccaacgtcaccacttccatctgggacgatggcaaggaagtgaccgagccaaacgttcacggtgaaatcatcatcgccggcgagtcggtagcccccggctacatgaacaacccggaaaaaacagcggctaacttcttcaagctcaacggggtccaagcttaccggactggggacgccggctacatcgatgaagacgggatgcgccacatcatcgggcggatggacttccaaatcaagctccacggtttccggatcgaactagacgaggttcgctccagccttgagcttagccagtacgttaagcaagccgtcgccgtaccaaagtacgctaaggacggcaaggtttcccacctgatcgcctacatcatcgccaaggataacgactttgcagacgacaaggcgctgaccaaggcgatccgggccgacttaaaggatcagatcatggactacatgatgccgacccagttcgtctacgtggattccttcccgacctcggccaacggtaagattgcggttaagcaaatgatcgcggaggctaacgagtaatgttaacctggattcaaacccttcctaattacaccgcgtacggaacgccgctttacttcatctacctgatcgtggcgatcctgcccctgtcgatcggactttacttcggcaagcgtttctcctggtacgaagccctgatctcctttatcttcatcttcttgatgtttgacgggaccagttataagcagggcctttccctaattggttacctgatttaccagaccatcttggtgatctggtacttccactaccgccagcaaaaaaacaacagcctggtcttttacgtgaccgtcgccctgtcgttattgccgatcgtgatcgtcaagttcaccccggccttcgttggtcataactccctgctcggtttcctagggatttcttacctaaccttccgggcggccggtacgatcattgaaacccgtgacggggtggttaaggagctcaagtggtgggaattcatccgcttcatgctcttcatgccaaccctgacctcgggaccgatcgaccgctaccggcgctttgccaaggattacaagaaggtgccgagccgcgaaaagtacctcgaaatgctgggcaaggccgttaagtacctgttcatcgggttcttatacaagttcgtcatcgactacttctttgccgaacagtggcagcccttctttgaacggatggcgatgcaacacgctccccacctctcctggtggacggtcggggtcgcctacatgtacaccgggaacctcttctttgacttcgccggttactcgctgtttgccgtcgggatctcctatttgatgggggtcgaaacgccgatgaactttaaccagccgttcaaatcgcccaacatcaaggaattctggaaccgttggcacatgaccctgtcgttttggttccgtgattacattttcatgcgcttcgttttcttggccaccaagaaacgctggtttaaaaaccgtaacgtcctctcgtcgacggcctacatgctcaacatgatgatcatggggttctggcacggggtcacctggtattacatcctctacgggttcttgcacgggttggccctggtcgtcaacgactggtggctgcggtacaagcgcaagcacttcaagatcaagaccaacgcctttactaagggcgtcgcgatctttatcacctttaactttgttgttttcacactgttgatcttctgtggtttcttagacaaactctggttccacccgttcgggatgtagccgcgacttaacatttggaggtatttaccatgattgaaaagattcaagaactcttagcccaagcaactggccgtgacgccgctgacttcgccgatgccgacgaaaacctctttgactccggtttgatcgactccatggccaccgttcaattcctcttctccttgcaagacgaatacgacatcaccgttccggtgtccgaatttgaccgtgacgaatggaacacggtcaacaagatcgccgaccgggtcaaggaattacaagcataagggtagctgaccgatgagcaaccgtaaaaagctgtggtcaatctttggcccgctgatcgtggccatcctaatggtgatggtggtctttttgctcccctggaagtttaataacaccccagcaatcgaacaaaaggccgccgattccttatccgccacggtctttaaaaaccgtaacctcaaggtggcggccctaagtgacaagaaggctaattacgtgcccttctttggttccagtgaactcgcccggatggacctcttccacccgtcggtaatggccgctcgttatcacgactacaagccgtttttgtttggttcccggggaacgcaatcattgccccaactctttaacatggcaatgatgaacaagcagctcaagaaccgcaaggccgtttacatcatctcgccgcagtggttcgtgaagcaaggggtctccccccaggcctttaagtattacaacggcaacttcgccgattacatgtggcttgaacaggcgaaccctaagtccccttacgatcgctacacggccagccgcttagtgatcctcttaaacgaccagggcttcgtctccagcctggcttacaagatcgcctccggagaagccttatccgccgccgaccgggctaacatcaaggtccgcttgaccttcttgtctcacgaagaccagctcttctcgggcttcttcttgaacaacaactacggcaataagattgccccgcaaatcacccagttgccacgccagtacaactaccaaaagttgatgacgatggccaagcaaatgcacgccgaacaatcgaccaacaaccagtttgggatcctaaaccccttttactccaagcgcctaaagaagagcgtcaagaacttaaagggggcccaaaagaactttacctacctgcaatcaccggaatataacgacctagaagtggtcttaaagcagttccaaaagaacaacaccgacgtgattttcatgatcaccccggttaacactaagtgggaaaagtacaccggtatgtcaatgaagatgtacgaacaaacggtcaaaaagatcaagttccagctgcaatcgcaaggctttaacaacatcctggattactccaaggacggggccaagaagggcttcatgcaggatacgatccacctcggctgggccggctgggtcaagtttgaccaccaggtttcggccttcatcgaaaataagcaaccggcgcccaactacaagttaaacgacgccttcttatcaactaagtgggctaacttgaagccaagcaccaccaacctcgataactttgaacagaattacttgaagtaaagtgggggatgaccaacctatcaagcaagccgtgggctaagtcagccttgcccacttacttctatcgtcgagcatcataaaacgggacctaccgcaacatgcggttgggtcccgtttttttagttatttaaagcccgcaaaggcctcttcgatgatttggtattcgctggacgtcagttccagttggagcgccgcggcgttttggacgacctggtccggttgcttggcgccgggaatgacggcggtgatgagtgggttttgcatgtaccaggccaagacgacctgactgaccgtggccccgtggctagcggcaattgtccggaccaccgctagggcgccgcggattttcccaaagcggggctccctaaaatcggccatcgtgctgcggatgtcatcggccgggaagctggtcgcctggttgtacttaccggtcaacaggcccgaagctagcgggaagtaagggacaaaggagatcccctgctcctttaagtagggcattaggtcgcgggcgttttgctgatggaggagggaaaactcgtcttccaccacgtcgacgtaaccatcggcgttggcctctttgacctgcgccaaggagaagttcgacaggccaatcgcccgaatcttccccgcttctttgagccgctgcaaagcaccgaccgcctcggccttgggggtgtcttggtcggggtagtggatgtagaagatgtctaagtagtcggtgcccaggcgctggaggcttttttcgacctgctgggtcaaaaagtccgggtggttgttgatgacccggtcgccgattgaataatcgtgggcacccttactagcgagggcaaaggagtaacggtcgtagtcttgaatcgcctcgccaattagggtttcggggtggcccagcccgtagacgtaagccgtgtcgatcaagtggatcccgtgatccagggcggcccggaccacgctaaggccttgctcatcattcaactggggaaagaggttatacccgcccacggcgttagcccctaaaccgaggggcgttgcgaccaccccggagtgcccaaactcaacttctgcttgcatctgtgacgccacctttccaatctcgcgttaattcaaagttcattataccctctgaaaacgcttgcgccaattcggaaagggcgttggctagtcaaccacctcagaggtagcggcttggcgaacccgccaggcgtgaacacctagaccgagcactaagccgaccagtgcgggtacgacccaggagagccctaggccggacagcggcaacaggtcgcgccaggtggcgaccagtttcccaaaggcggaggctgaaaccacgctcgggaaggcgaccaccatgtcccccagggctggcacgatcgtcattaccaccacgaatgcgtagacgaccccatcgcggttaaagaagggcgaaaagaccgataaaaggatcaagaccattgccagcgggtacaagaacatcagcatcggcgttgaccaggcgatgatttgttggaggccgaagttagcgatcacaaaggaggccaaggtcgtcagggtcagccaggcgtggtaggaaagctgcgggaagtgcttgtggaagtcctgggcaaaggcggccactaagccaaccgccgtcgtcaaacaggtgacggtgattaagacggctaagaccgcttggccaaaggcgcccccgtagtagttgaccagttgggtgaaggcgaccccaccgtcagcggatagcttgaagcggcccaaagacatcgccccgaccacgattaagagcaagtagattaaggcaacgccggccatcgccaagaacccggatttggcaaccaccttggaaacggcgccggcacgcttttgccccatttggcgcacggcggttaccaccgtcaccccaaaggccaagccggccaaggcgtccatcgtgttgtacccctgcaagaagccgttgacgaccgagccacggacgtaagcggcggttgccgtcgttgtcattgggttacccagcggccgcaagaaggccaccaaaaacatcaagaacaagaggaccaaaaacattgggtttaagaccttaccgacgttggccaggatgctattttcccggtaggagaaggcaaaggcgaggccaaagaagaccgccgaaaagactaagagggcgacttgttggtactgggccgggacaaagggggccaccccaacggtgaaggaaacggtcgccgtccgcggggtcccaaacaaggggccgatcgtcgcgtggatcaagaccatgaagacgagggcgaaaacgacccccagtggtcgaccgatgtcaaagaccccctcggcccgggtgatggcgatcgccatgaccgacaagagcggcaacaagaccccggtaactaagaacccggcggccgccccgacccagtggctaccggccaactggcccaggtgcagcgggaagatcaggttcccggccccaaagaagaggccaaataatagtgaagcaaccacaaagtactggcgcttggtgagctttggtgacgttagatctggcatgaaaaatccctccataaactaatccaaacgcaagtcagtaacgaaaaagcgccccctaaccggaaactccggttaagggacgctttgcgtggtaccaccctggtctttgccggcccatcgctaggccaaccttactgcgtacggcccagtaggcgatacgcgcacacgataatgggtgtgtaaccactgaaccttggttggctcaggctcgaaagtgattttcacacggcaaccttccggcccccttccaccaaccggggctcgcttgcggtgtcgccgtgctactcttctttctcattgcgttcggacgattcaatttatgtgaataattctagcggcgcccccattattcgtcaatccctttctcataatttcccaaaaaagttttcgtccggcgggtgtgctaaaataggaaagcaccaaactgtccgttacaaattaagaggtattaatatgcaaaaaccaacacaccgtaacttcaagcggcggcccaagcgctacgcccacccggtcgacgctaaggtcggcgaccgcttccccctgtcaattaaaaaactcggggtcgaggggcaaggaatcggctacttcaaacacaaagtctgctttgtccccggcgccctgccgggagaagtggtcgtcgctgaggtgaccgtcgtccacgacaactacttagaggccaagctccaccaactccgccaacccagcccggaccgggtcacacctaaggacgcctacgctgggctggccgggggctttgaactcgaaaccctggcctacgacaagcaactggcctttaaaaagcaggtagtcttagaggcactggccaagttcaagcccctgggttaccgccactactgggttaaggataccctggccgccccgcacccctacggctaccgtaacaaggcccagttccaggtccgcatgcaagatgggcacgtggtggcgggactctaccaagccaacagccacaccgtcgttgacatgcaaacctgcgccgttcaaatgccggggacgatgaaggtcatcaacaccctggtcaaactgattgaggaattggcgatcccggtttataacgaagccaaccagtccgggatcatcaagaccctggcggtccgcgaatctctggcgaccggacaaattcaggtggccatcattaccaacacggccaagttgatcaaaaaacacgccctcttggtggcgattgaagaccaactccccgaagtcacctcggtggtccaaaacgtcaaccccggcgacacccccctggtttggggcgacgagaccaccctcttgtacgggcaagactacatcaccgagagcctgatggggctggacttccgcctgtcggcacggtcatttttgcagctcaacccggaacaaaccgaggttctatacgaagaagcggctaaggccctggacctgtccaaggacgacaccctgatcgacgcctacgccgggatcgggacgatcggcctgtccttagccaaccgggtcaagcaagtgatcgggatggagacgatcgccgacgccgtccaagacgccaacaataacgctaccttaaacggggtcaccaacgcccgctacgaagtcggcccggccgaagagctcctgccgaaatggcgcagtcagggccaacactttgacgccctggtggttgacccgccgcggaccgggctggacaacgccttgatcgatacgatcctccaggaaaagccggccaagtttgcctacgtctcctgcaatatggccaccttggcccgtaacctagcccgcctggtcccgacctaccgggttgcttacatccagccggtcgacatgctgccgcaaacgccacgctgcgaagcggtggttaagttggtcttgaatgaaaactagaagtgcggaccaactatcagcaggccgtgggctaaggcctagacacaggttagcgcaccagcggtgttctgtggctggacttagccactaggtctgcggttggggagcacgttattagaagtgcgactcaacctcctcgacgggccgttggactaagctaggacgggggttgatgcggcacgcatcgttctccggccgtacttaggcattaagcccgtggttgggagcacattattagaagtgcggaccaaccgtttggactgcggtggcactagtcaaacagtaaaaagcgttgtccaatctcgggggttcacttcactcctagcccttttgcctttatctcgccctcactgcggagtcaagacaatgaacttataatttactggtccgcaccgcagtacgccaatggcatccagctggtcggcaagccgacgctagctagatacctattggcgcttgcgggggagcgacgacgaaatcaaagatttctgtcgctctccctactctactacatgccgttcaaacggttggtcggaaatcccctggtccaggatcgtcttggaccattccttggcggagaagagggagtggtcgcggtagttcccacagctttcgatcgtcgtcccctgtacgtcttcccattcggtgtggtaggcgatttcttctaatgaggacttgagggccttggcgacgtccgtcgtcgagtgttcgccccaggtgatcaagtggaacccggtccggcaaccaaacggtgagcagtcaatcaccccatccaggcggtcccgcaagaggccagccaggaggtgttcaatcgtgtgcaggcccgccgttgggatggcgttttcgtttggttggaccagccgcaggtcgtagttggcaatcttgtcacccttaggaccttcttcaaccgtgatcagccgcacgtaaggggccttcaccttcgtgtgatcgagcgtgaaactttcaacctttgccataactatcttctcctttatttaaaagttaataccacttcattatacaacccgggtcaaccattaaccccaaacttgcttggcaacttcgacgaccagcttgatcttagcccactgttggtcttcggtcagctggttcccctcttcggtcgaggcaaagccacactgggtcgataaggcgaggtcgtctaaggacacgtactggctggcctccttgattcgggcaactaggtcagctgccgcttctagctctggtttcttggaggtcactaggccgaggacgacttccttgccggccgggacttcttggagcggttcaaagcccccggagcgctcgtcgtcaaattctaggtaaaaagcggagacgttttccttggcgaagacgtacttggccaccgggccgtaaccgcccttggccgcccaggtcgagtgatagttgccccggcagatgtgggtcgacacccgcaggtcggccggtagatcaaccagtgcaccgttattgacttccaagtacttggccgccagttgttcccggtcgaagccggcgtcggccatgctttgccagaagtcgtcgtcaacgaccatcccccaggtacagtcgtctagcttcaagtcgcgacagccggcgtcgtacagggctaagatcaggtcacggtaggccgtcgccaggtccgttatcaggtcgtcttcgtttgcgtaaacctccttgagcttagcgatgttttcgtccccccggtagagttcggcgtaacactgggccggtgacgggatcgattgacgaggaactaggtcggtgccgtcggtcaggctcttcaaatacttaaaggtggtcaagtcggggtgtgcgccggtaaagcgaatcttgcccaccacttgggccgaatcgttgcgggtttcttcgtcgtggaagaagtagccgtgggtttgggtcgtgtgttcgatcccaccaaagccccagaaggtgtctaggtgccagtaggaacggcgaaactccccgtcagtaaccaccttcaggccggccgccgcttctttttgaaccagttccttaatctgggcgtcttcgaccttggtcaagtcggcttgactcagctggcccgctgcaaactgttcgcgtgcctccttgagggcttgcggacggaggaaggaaccaacgatgtcgtagtgtaattgtgttgtcatagtgaaaatcccctttcaattttgccaatttgcgaagccgctgaaaataaaaacgcccccgaagccacttgtgcttcagggacgcttgatcgtgttaccacccttatttgaccccacctcgcgatcgggtcctcagtgggtactccaaggaatacccagacgcaatatcgggcgtcatccgcggtccgctcaccatcgtttgcagagccggattgctccaagaccatcttcaggacctttcaccacggcggcttgcacctatcccgcctctcttaggaggtttccggtccttactcatctcttctcagctgtttctcattaaattgtcattatcttaacctggtcggggggccttgtcaactagcttttaaaaactccttacagcagctggatcttggccttagcgcaggcttctttcatctcttctggccaaatcgaggcttggacttccccgacgtgggctttgccgagcaaaagcatgcacagccgggactggccgatcccgcccccaatcgtgtacggcatcttgccggccaagaggtcgcggtgaaacggcaattcggcccggtcggtagcgtgagccttttccagctgttctttcatcgcccgttcgtcgacccggatccccatgctggagacttccagcttggtttgcagcggttcgtaccagaagatgatatcgccgtttaaggaccagtcatcgtagtccggggcgcggccgtcgtgcggttcgccggagcgttgcagcttgtcaccgatcttcatcacgaagacgcagcccagttccttagcgatcttgtcttcgcgatccattggcgaaagctctggccagcggtcctctaattcctgggtggtcacaaagtgaatttcgtccggcaggtggtaaacggcctgcgggaacttgtaccaaacctcgtgttccatgtgcttgatgaccttaaagacctggcgtacggttgccttcagggtggcttcggtccgctcttctttggcgatcaccttttcccagtcccactggtcaacgtaaatcgagtggaagttatcgaggtcttcgtccttacgaatggcgttcatgttggtgtaaagcccttcgtgtaagccaaagccgtacttctttagggcaaagcgtttccacttggccagcgagtggacgatttcaatcgtttcaccgggcaggtccttcatggtaaaggacaccggggcttccaccccgtttaagttatcgtttaacccggtgctttgttcgacaaacatcggcgccgacatccgttgcaggttcaactccttgccgatttcatcctggaaggtttcacggatgtaacggatcgcttcttcggtttcgcggattgacagcttcgggtcgtagttttctgggataatcaaagacatttaggttcctcctttgcctactaacacagttggacggttttatcacccgttaatcataatctaattttaacgaaggggcgctcccattgcaaccagacaaatctgccgacttttaacgctttttcggtgaagtttttccgattaatggtttaacggcccaccaccccgctataatggggaaaactgagaaaggatgattgatgtgaagaaaaatgacgacgtgatcgtcatcgtggccggcatcatcgtcagcctcctcgtcgtgctcggcgtcgggattggcgccgcctactaccaacaaacctcgctttcgcaaacccactccgctaagatcaccaccaaggagttcatcaaagaaatcgccccggccgcccaagcggtggaaaagaagtacgggatccccgcttcgatcatcatcgcccaggccgggaccgaatccgactggggacgggccaaactagcctacaagtacaataacctctttggcatcaaggccagcggtaaaaccaaccgggtgaagatgtacaccaaagaaaccctcaacggcaagaccgttaccatcaagcagtacttccaggtttactcctcgtggaaggcctcaattgacgcccacaccaagttgatcttaaacgggaccaccgataacccccaccgctaccggggcgtgattaccaagtcctacaccaaggcggcctgggccctgcaaaataacggctacgctaccgaccccaattacgcgaacgaattgatttacgcaatcaaaaagtttaagctcgaccaatacgattaaccagaaaggatcctgtctatgaaccctactttcacgctggccccggccacgaccgctgacgtcttagccgtcctagaaatcatcaaccacgccaaggccttcttgaaggcggccggctcgacccagtggcaatccggctaccccaacgccgacacgatcaccactgacatcgctaacgaggtcggctgggtgctaaaggccgatcaccaggtggtcgggtacgccgccgtcatcgttggcgaagaccccaactaccaagaaattgacggggcctggcaaaatacgaccgccccgtatgccactatccaccggatcgccatttccaaccagtaccggggccaacaccttggccagcgcttctttaagctaatcattgaccactttgcaggggggggcgtccacaacttccgcgtcgacaccttcaagctcaaccagccaatgcaacacgtggctaagagcgccggctttgagtaccgggggatcatcaaggtggtcgacccagttgacccggcgcgcttggcgtttgagttgaatttgtaggaagtgcggaccaacctcctttcaatcaattacagaagtagctgaagatccacgtttttaccgatgcgatctccagcttttttcaattttcgactgttatacagataacgtgcttcccaaccgcaggcctagtggctaagtacgaccacagaacactgcgttccgcgctaacctgtggtcttgtccttagcccacggcccgcttaatggttggtccgcacttctcgtaaccgaacacttgttccgataactaaaatctgctatgataggggtgatttacgaaggggggtggcccgcgtggcccaagagcacacctacatcgccattgatttgaagtccttttacgcctcggcggagtgcgccgcccacgggttggatcccttaaacgccaacctagtcgtggccgacgcctcgcggaccgacaagacgatctgcctagccgtttccccagccctaaagtcgtttggcgtccccggccggccacgcctatttgaagttaaccagcaagtcgaccgggtcaaccgccagcgggccgctaagtttgccaaccggcgcctagccaagacccgctcgatctacaaggacgaactggaaagccgcaccggcctgcgggtcgatttcatgatcgtgcccccgcggatgcgctactacctccaggtgtcggctaagatctacgagatttacctccgcttcatcccgccggaaaaaatccacgtctactcgatcgatgaggttttcatcgacgccaccaattacttggccacccaccacgaatcggcccacgcactggccaaaaagatgatccaagcgatccaggccgaatttgggatcaccgccaccgccgggatcggcaccaacctctacctggccaaggtcgccatggacatcgtggccaaaaagatccccggcgacgctgacggggtgcggatcgtggcgatgaccgaacaagattaccgccgcctcctgtgggctcaccaacccctgaccgacttttggcggatcggccgcgggtacgcccgccggctagaaaagcttggcctccacacgatgggcgacatcgcccggtgctccttaggcaccctgtcggacccgcaaaacgaggaggtcttgtaccgcgagtttggcaagcacgcccagctcctaatcaaccacgcctggggctacgaggccgccacgatcgaagacattaaaaactaccgggccagcgaacacggcatttactccggccaagtactgatgaaaccctacacgatcccccaagcccgccaggtgatcagcgagatgagcgccgacctgtccttgcagctggtcaagcgccacgctttgaccaaccagatcgccctgcacctctcctacgacgttaagagcatctcctacgccagcaactaccacggcccgatcgtaaccgacttttacggccgccaggttcccaagcccgatcacggcggtgccaacttacccgacctcacctcttcgccccgggagctgcggggtgcctttttggacctctacgaccgcatcgccaaccgggacctcttaatccgtaaggtaacggtgatcgccaatcacttagttgatgaagaagaggccaccaaacaggtccgcaccgagcagttaaacctgtttgaagacccccaccaaaaggtagcggaacaacaaagcgcccagtcgacccgcgaccaggagcacgaggtccaagaactagtgttaaagctacaagaacagtatggtaaaaacgccattatccgggccgccgacctcttagacgggtcgaccacccgtaagcgcaacgacgagattgggggccacaaggcatgaacaaaccagcaccagaccaacaaacggcggccatcgaggcccgcctctttaaagacaccagcgcctaccaagacatcatggacctgccccggccggtctccaagcaccactggcccctaccggcggccgaccacgctggtcagttcgctccctttgcggccctgactggctaccaccagctgatcaacgaggtcgccgagcgctacagccacaagaattaccccgatgagctgagcaccaagcgcattgagcgtaagttactggccatcaagccgctcttgcccctacgcctcaaggtcgaatatttcaacggcgacagcggctactacgaaacaatcgcgggcaccgctacccagctcgacttcaggcggggccggctgatgctgaccagaaagcaggagtgggagctaattatcgccaacctgcggaaggtgacggtggtgacgagaaaataggaagtgcgacccaaccattgggcaggccgtgggctaaggacaagaccacaggttagcgcggaacgcggtgttctgtggtcggacttagccactaggcctgcggttgggaagcacgttattggaagtgcgacccaaccgtgggctaagctagggggaaggttggcgcccccggcggcgttctttacccgtacttagccactaggcctgcggttggggagtacgttataggaagtgcgacccaaccattggcgggccgtgggctaagctagggggaaggttggcgcccccggcggcgttctttacccgtacttagccactaggcctgcggttgaggagcacgttattggaagtgcgacccaacctcaccagtgaatgcacactcattaagtaaaaaaagctgaagatcacgtctttttagacgtcgatcttcagctttttgttttaactgtgctacagatgacgtgctccccctagtccacccggtgcatcgcttctttaacgtagcgttcggtcccgtcggccaccgcctgggtgtagtaagcgcacttgaagtcgaccatcttcatcgtctcctctagggtggccagcttggcttgcagccgctgtttgaggtcgtaaaacatcgcctggcgctccgctaaggtggcgtccccctggctggctaattccatgaaggccttgatgtctttgattgacatcccggcgtttttcaggcactcgaccacgtctagggcgccgaggttttcgtcggtgaactggcgcaccccgctggccgacttacccaagccggggatcaggccctcctggtcgtagtaacgcagggtggccacggaaaggtggtacttacgggcgacctcgccgatttggtaagtgtgttccttaattgcttccattccaattctcctcaagttaactttagcttccattttacgccaaattaagggcgccgtcaccagtgattcaccaacataaataaatctattaattcagggtgattcttaacttatattaagtatcaatgagggattactttccccaccgccccttttaagcgcctttagctttcaaatattaactaaataccatgaatggttacataagtaccggcaataacttttgacaagcaagttgaaagctggtacatttaaaattgatctcactattttttaatgaaaggaggcgccccgatggattcttaccaattaaccccgctgggcgaccaagccctggtgattaccatgggcgattcaatcgacccggtcgtcaaccggcgcttacaaaccctgattaaagaaatccgccaggccaacctacccggtatcgtggccctcatcccggcttattcgactttaaccgttacctacgatggcatcgtcacgaattacgacaagctcagccacaccctcaagcccctgatcgattcctccctgagtgcccccttagccacgcccactacctggctaattccggtccgttacggtggggatggggggccggacctcgccgacgtcgctaattttgctgaccagagcaccggcgaggttgttcaagcccacaccgaccaggactacctgatctactttctcggctttttacccggctttgcctacatgggtagcgtcgatgacaaaatcgccatgccccgcttagccaagccgcggctggaaatccccgccggtagcgtcgggattgccggcaagcagaccggcttttacccggtggcttccccggggggctggcgaatcatcggccagaccccgctgaacttgtacgatcctgcccacccgcagagcttttactccgccggcgaccgggtccgcttctttgccgtgaccgaccacgagtttgacctgatcaaaaccgacgtggccaacggtacctaccaagtaaaggcggtgaattaattgagtttacgcgtactaaaaccgggcctgcagactaccgttcaggacctcgggcgccctaaccaccagatcgacggcttccccacctcgggggtaatggaccaacccgccgccatcacggccaacttattggttggtaaccccgcttccgccgccgtcttagaattcttcatggccggcccgacggtcgagtttacggtcagcacctttatcgcccttggcggggccgactttaaggcaaccttaaacgaccagcccgtcgaccccaaccgctgttaccaggtccacgagggcgaccggctcgctatcggccacgccgctagcggtcggatcggctacctcgccgtgaccggtggcctccaggtcgccccggtgctggggtcgcgttccaccaccctgcgcctgcagttgggcggctactcgggccggcccctgcaagccggcgacgacctgccgattgaagaacacttaaccctgcccggctactaccaccgccacacgaagggctccgcaccggtttcaaaagacaccaccgctaccatcagcgtgttaaagggtccccagtgggactggtttgacccggccagccgggagtcctttttggacaccacctacaccgttagcaaccaatccgaccggatgggctaccggctcagcggcccgaccctgccggtgccggaccaaagcatgctgtcggcggcgaccgtaatgggggcgatccagatcccggccagcggccaaccgatcgtcctgatggccgaccggcaaaccaccggcggttacccccttttagctgtgatcgccagctccgacttgccgaccttcacccagctggccccggggcaaaccgttcagtttaacttaattgaccaagcagaagcccaaacccgcttggaagaggggcgccgaaccattaaccagctggcccagaaactgcgctcggccgcctttttaccgccctacggaattacccgggtggccaaccagcggatcgccactttatttgaggaggagtaaccatgaacatcgatgaaccaaccctagacgccctaagcaagctcttggataagtaccacctgagcgagctaacctaccaaaccggcgaccagaagatcaccctcaaaaaagaggccccggcaccggtcaccccggcagttagcgcaccggctccccacgccgccccgccagtccgggcgccgcacctcgaagccagtggtaccacgatcgacgccccgaccgtcggcgtcttttacaccgctaagtcaccccaggaccctccctttgtttccgttggcgacaccgtcaaggtcggccaagtcgtcggcgtgatcgaggcgatgaaggcctttaccgacgtggtggccgacgtcgagggaacggtggcggccgtcctagtcaataacgaggagggggttgagtatggccaaccgcttattcaaatcaaataattcccgctcccgctggcccttccacaaggtcttgatcgctaaccggggcgaaatcgccgtccggatcatccggacctgccgggtgctgggcctggccacggtggcggtttattcgacgaccgacgccaaggccctccacgtcaagttagccgatgaggccgtctgcatcgggccggggagcgccgagaagagttatttaaacatcagcgccctgattggggccgccttagtcaccggggccgacgccgtccaccccggctttggcttcctatcggagagcgtcgcctttgcccgcgcctgccaggacaacgatctgaccttcatcggaccaagcccggaaacgatcgccctgcttggtgacaaggaggccgcccgcctgacgatgcgccgggccggcttacccctggtcaaggggagccaagagcccctccacgacttagcaaccgccctggcccaggccgaagaggttggctacccggtgatgctcaaggccgccgccgggggtgggggcaaggggatgcggatcatccgtaacgccgaggaaatggaggccaagttcgccgtcgcccaggacgaggcccgggcctcctttaacgacgaccagatgtacttagaacagtacctggcccacccgcgccacattgaagtccaggtgattggtgaccagtacggtaacgccctggccctgggtgaacgggactgcacgatccaggcccgccaccagaaggtgattgaagaggcgccggccgccgtcttaccggccccggttcgcgaagccatgctggcccaaagcgaacaggccgccgcccagctcaagtacgaaggcttagggacgatcgagttcttgtacaacgaggacggttcctattacttcatggaaatgaacacccggatccaggtcgaacaccccattaccgagctgaccaccagggtggacctggtcgaaagccagttcctggtggccgccggggcccagttaaaagcggagcgccccgcctcggttggttacgccatcgagtgccgggtcaacgccctaacaccgggtaagatcaccgccctgcacctaccgggagggccgggcgtccgggtcgacaccgccctttaccagggctacacggtaccgagtaactacgacgggatgatcgccaagctgatcgtctacggtgaacggcggcaacgggccctgcaacagatgcaagcggtgatcgacgaaacggtgatcgacggcatcaagaccaacttagacctcttgattgagatcttacaggcgccggccttccagcgcctgaccaccaccgttaactggttagacgaccaaatgaacccgaaccaaaaggaggagcaagatgacgaggattgatttaaacagcgacctgggtgaaagcttcggccgctacacgattggtaacgacgaccaggtgctggacctgatcacggccgccaacgtcgcctgcggtttccacgccggcgaccccgacgtgatggcccagaccgtcgccctggccgaggccaagggggtcgcgatcggcgcccaccccggcttccctgacctggggggctttggccgccgcaagttagacatggcgcccgccgaggtcaaaaacatggtgacctaccaagtcagcgccttaatgggctttaccaaggaccaccgcctccaccacgttaaacctcacggcgccctgtacaacgccgccgctaaggacttagccctggcccgggccatctgcgagggggtcgcccaagttgacgaccaactacccctctatggcctggccggcagccaactcctggtggccgccaaggaagtcggcctccccgcttattcggaggtctttgccgaccggggctaccaggcagatggttccctagtgccccgtagccaacccaacgccgtcttgaccgacccgctggccgtggccgagcgggccctttcgatggtccaaacccagtcggtaaccgccgtgactggggaaacggtgccgctcaaagtcgacaccatctgcgtgcacggtgacaaccaggccgccttagccctggtggaccagctacgccaaacctttaccgccaacggaattaccattcaagcatgttaggaggaactgccgatgcaagaaacgactgatcaccgccgtaccgttcgcaacgccgcgattgggggcgcctttttaatggccatgtcggccgtggggcccggctttttaacccaaaccgctacctttacccaacgggaaggggctaacttcggtttcgccatcctgatgtgtatcatcgtcgacgtcatcgtccagctcaacatctggcgcgtcatcatcgtctccggaaagcgggcccaaatgatcgctaacgacgtcttccccggcctgggctacttcttatccctgctcgtggcgatcggggggctctttttcaacatcggaaacgtcgccggggccggcctggggctcaacgtcttgtttgggatcccgaccatttggggcgccgtaatttcggccgtcgccgccgtcttgatcttagtgatgaaaaacgccctgaaggccgtcgaccggaccgtccaggtgctggcggtcatcgccgtcttggtcctcttgtacacgctggcgatcatgaagatcccgtatgggacggccgttagccacacctttatgccgaccaaggttaacttctactcgatcctgacgattgtcggcgggaccgtcggggggtacatctcctttgccggggggcaccggctcttagaagggggcgcccaggggaccaaagacctcggtgccgtcaacctcggcgccctgtccggaatcgggttagcctccgtgatccggatcgtcctcttcttgaccgggttagccgtggtcttaggtggtgccaccctagacgccgccaaccccgccgccacgatctttaaggtcgcggccggtacctttggctacaagttctttggcctcttactctttgcggccgggatgtcctcggtgatcggttcaacctttacctcgatctcgttcttggactacaccagccgtaaaaacgaaaacaccgaccacaaccgccactacaagatggcgatcacgatcggcttcattgcctttgcgacgttgatcttctgctttgtcggccaaccggctaccgtcctggtggtcgttggggcgatcaacggtttcatcttaccaatcgccttagggatcctgctggtggcctcccacaagaccaagatcatgggggcaggctaccaccaccccgcttggttgacttggaccggctggctggtcgttatcttcatggcttacgcagggattaacacggtattaaacctattgtaagaagtgcgactcaaccgtaaagcaggccgtgggctaagtaaatactaaccaatcaaaaagggctgcgccgagttggcgtagccctttattgttagtattgtgcgctctggtagcgccggcgtaagaataaggcggccaggaccgccaacaccccgtagaccgccccgacgttaccgacgtgggtcaggcctaagaagcccaccgtttcggccgccgtaaaggagcccagggaaatcccgatgttagcaaagatcgagtttaaagacgaagccagctccaaagactgcgggtagtccctttcggcgatgtctaaaaacatcagctgggtggacgccccataacaagcgatagccacgcaaatcagggcgatggccaaaacgtccaaccacggaaagtggaagagcggcgccatcatcaataacaagcaagtcatcataaagtagatgtggggcagttgcttgatcccgcccatgtcggctaggtaaccgccaaacttgttgccgatgataaaggcgacccccatccccagcaagatccagttcagggtactgatcgaaaagcccatcatcgttgacaacagcggccggatgtaggtgtaaaaggtgtattggccggcgcagacgctcacgaccaacccgacccctaataggatccgggcgtccttcaaaaggctaaactgggccaagagactccccttggtggcggtgtcttcgcgtggcaccaaaagcgccaagccgatcaaaaccagggtggcgatcccggtcaccatccaaaaggaatcgtgccaagaaaaggtggtgctgatcatcgtgccgatcggaatcccgatgatcgaggcgatcgaaaagccagcaaagacccaggaaactagcccggcccgcttctcgcgcggggccagttgggccgctaagattaaaactagggagatgatcgccccggacacgctcgccgtcaaaatccgcgacaagagcagtgaccaaaaacccccggccagcgccgtccaggtgttgccgaccaagaagatggccatgtaaaccaataagatgtcatagcggcgaaaacggctcgctatggtggtcaagaccggcgtcaacagggcgtacaccccggcaaaaacggtcaccaaataacctaaggtggccagtggggtgccaaattcacccttaatgtctggcaagacccccacgatcatgtactcgttgcagcctagcataaaggccaccatcacaaataaaacggcctgcagccggtacttggtcatcaataactcctcccatcttttgcctcgatcattaagatcaaggaccctacacatttgattcgtcgaaacattattcagttttcaaaggtctaccgttgccgacgccttaacgcgacaactttttaagtatatcaacatttgatttgaatgtcaacaacttttttaacttgcgttgctagcgaagaagcaatgcctcgctgacaacagttattactatactcacttcaaccccacccgtcaagcgcccatttcgacccgctatctctcctccgccaattaaagatcggtttttgctccctccacgcgttcctcttcatcacttatgcgaacattaaccgctatcattgaccaacaagatgaccaaacccgaaccctaccacccaatcgttcggcaaaaaactttttaacttttttcgcaggtccttaaagacagggcgtcccaccgttaaacaaccactaaaaaaacccgcaccaccaacgatgcgagccctaatgcctaatcggcagccggaatgttgatatctaattgaatgggggcgtggtcgcgtcgttcaccggaatcgatcatcgttgacgaaacaacttggtcggccaaacggtcgctaactagccagtagtcaatccgccacccggagttattcaccttactggtgaccgcccgttgcgcccaccaggagtaagccccggtttcgtccgggtgtagggacctaaaggagtcggtaaacccggccgccagcagggccgtgaacttctctcgttcctcatcggtaaagccggccgaatggtggttattagccgggtgcgccaaatcgatttcctcgtgggccacgttgaaatcgccactggcgatcaccggcttttgtcgatctagttcggttaaatactcccggtagcggtcatcccattcttgccgttcagccaatcgcttgagtccggtcccggagtttggggtgtaaacctcggtcaaatagaagttttcaaattccagggtgataatccgcccctcttcgtccattggctccggggccccaatcgttgggtaggtcaccttgggggtcaaactttccttatataggtacattgtcccagcgtaccccttgcgcgccggctcgaccgaggagcgccaaacgaccgtgtaaccggcaaacagctccgccaaaactccctggtgctttttagtcggtccactcttggagagcttggtttcttgaatggcgatcacgtccggagcggccgccttgatcttttccaaaacggcgcgggtttcttcggcccgggccgaggtgccggttaaagcagcgttgattgaatcaatgttccatgaaataaagcgcatcgtatcgcgtcccctttgtctttaatctctccattataccgcgatcaaaacggcagcgcccttctggtgatcgcaaaaaaacgggcgctagtctcctaacgtccgtatgctagttgtatctgcctttcagcttagttcctggaatgacgcttcttcttgcgcccaaccccgagtagagtcaagaggctcaacagggaaaccccggtgaggctcaatgcggcttgctcgtcgtcgcccgtctgtggcaacttctgctcgcttaccgccgatgttgccttagcggccgacgttggcgccgtgtttgttaccgccgccggagccgccgaaacggcactggcggagttcgtggctgcgctggcagcgctagagcccgcgctagccgagtttggtaccagcttggtgtaggcgatcgtcacggtgacgtcgccatcgccgtctttaaccactaacgccggcaccaccgttgggctggccgtgtagccggccacgcttggaacggtgaagcttggccacgtggcagtggtccactgcgagtaggtctttgcacccgtcaccaggtcctcttcaaccgtccgggtgagttcggccgtttgggtgagcgaagtcagctccttggtggtgggatcgaggtagttaattgtccgggtgatggtctgtgtttgcgtcgtggtcgacgtttggtgggttaagtagaccgtcacgcccgcgttttgggcgccaaaggttccactcaattcacttagcgggtccgtggcgttcttggccgtgtctagcttgtagccggccgccgcgtagtcccacttgtcgctggtcaactggtcggcgtaggagccggcggtcaccccggtcagggtgagaccgtggtcggttaaggtcgtgttagtcgtttcatcgacgtaggtgacggtgaagctttgcgggtcggccgtgtaggtcacggtggacgcttgggtcgggctgtccggcaggtaggtgccgtccgattgaagggtggcacccgttacttgggccgagtaccccgccaccgcgggtacactaaaggaagtgaccttggtggcgtcactttggtcattagtgtatgcagcggtcgttgcggtcccacccggcttggtgatcgtgacggtcccgaccggactgtaggtgaccgtgtcgctttcggcggttccctcgcttggcgtggcgttgtcaaccgtcgagcttgccttgtcggccacgtagccagtcacgaccggggtcgtgatgctggtgaaactggtcctgtcgccggtcacactccagtcgccatacgccgtcacgagcccggtcacggtatcgaccgtgttggtccgggtgtagtcaatcgtttggggctggctggttgggttgttagcggcgccggtgtaattgaccgtgtaagttgaggtcccggtttcttcttgggtggtcgtcccgtgctttaggcacaccactacgttaacgttcgtggcgccaaaggtcccgctcaggctgtccagcgggtcagtggcattctggtccgtgtccagcacgtagccggccgccgcgtagtcccacttgtcgctggccagggtcttggcgtaggatctgtccgtgacccccactcagggtgaagtcgtggtcagttaattcctcaccggtcgtgtcatcgacgtaggtgacggtaaaggactgggctttcgggctgtagacgtattcccaagtgtaatccttctcattggcggttggcgtttgggccggcacgatttctaccaccttccccgtcgtcccatcctcccctatcacgaacgtaatttgggttgataacgtcgccccgttcatggcaccgatgctgtagccgtcgacgcccaagacgtagacgaagacgccgcagaacccgtctcactgctggtgatcgtcacgttactactattactatcactgctagaagcaggtgttgaactagttgtcgttatctgagagttcgaaactgtatcggcatgaaccaccccgttgccgaggaagaacgtggttcctaaaagcaccgacactacgccaatgctcagtttgcgaatcccaaaacgctgcttttgattcaacatccgctcaatcttgatccgctgattatttcttgacaccactaatatcctcccttaaatggaactgctcccatcgtatttattaataccactataactttttcgtaatattaaaataattttacacagtttctagattgtcaattatatccataattaaaaatcgttttataaccgtcaaatcaacattgtaaacgcttatcattaattattacaatcggaattcatatcaaaatcttttcccaacttttgatcattaagcctggaagcggaaccgcttttataatcatcggtcattaagttaaaaaacttaatttctaacgagtttcttagcaaagacttactttactttaagaaaaccgttatgctagtactattctaatttttgaaagcgaggtctttacatgcatgatcaagcaaccactgtccggacggtcccacgcagtgaacgtcaagtcgccacgaacattttaaaaggatccttaggcaacatggtcgaatggttcgactggtatgtttacgcatcctttgcgatttacttctcggccgccttcttcccggctggcaaccaaaccgccgaattactagccaccgccggggtctttgcgatcgggttcttcatgcgccccttgggttcctttgtgatggggcgtttcgccgatcgaaaggggcgccgggccgccctcaccctctcggtgatcatcatggccggtggttccttagtcattgccctaacgcccacgtacgcccaaatcgggatctggtcaccagtcatcctggtcttgacccggttgatccagggactttccttaggtggtgaatacggaacgagtgctacctatatgtcggaaatggcgtccccttcccggcgtggtttctactcctcgttccaatatgtcaccctgatcggggggcagctcttagccctgctcgttcaaatcatcttgcaaaacatcttcaccaacgcccagctctacgcctttggctggcggatcccgtttgccatcggggccctgggagcgctcgtggtcttgtggttgcgactttcaatggaagaatctgatcaattcaacagcaccaacaagaaaaacaagcaggccggcacccttcggctgttggctaagtaccccaagcaagtcctgatcgtcgttgggatgaccctcgggggaacgatcagcttctatacttacaccacctacttgcaacagttcatgatcaacacgaccggcctgtctaaggaaagtgcggcgatgattaacttcctcgccctgctggtgatggtaatcttgcaaccggtcttcggtcacttatccgataagattggccgcaagccgctcttgatcttcttcggggtcggcggaaccgtcttgaccgtgccgctcttcaccctcttgaccaacgccacccaagcttggcaagccttcttactgatgttagtcggcgtggtcatcgtttccgggtacacctcgatcaacgcgatcgtgaaggccgaactcttcccggccgaaatccgggcgttaggcgtcggcctgccgtacgggttgaccgttgccatcttcgggggaaccgttaactacgtcgccctctggctgcgctccgttcacctggaaagtggcttcttctggtacgtttccggcaccgtctttatctcactcttggtttacatcttcatgatcaaaaagggtgtctcggcgctggataaagattaggaaaaggaagtgcgacccaaccattaagcaggccgtgggctaaggatagcgcgaacggttggtgcgccagcaccgttcttcggccagacttagccactaggcctgcggttggggagcacgttatctggaagtacgacccaaccattaagcaggccgtgggctaaggatagggcgaacggttggtgcgccagcaccgttctttggccagacttagccactaggcctgcggttggggagcacgttatctgtggaatagttaaaaaattaccccaaacaaaaaccgtcaatccgcaatcaaatttgcgaattgacggtttttatttagctaggactagcgtggaggttggttcgtacttcttaattttgaaacaacctcatccccgccggcgtcgccacctggtaacagtcgaggttaaagacctcgctcacccgttcggcgctcagaacttgttcgggcgccccactgtcaaccacttgcccctccttaaagagtaggcagtgttggccgtactggagggcctggtttaagtcgtggatgatcatcacgatcgtcagctggcgctgggcttggatccgttgcaagagctttaagaagttaacctgaaagtggaggtcgaggtaggtggtcggctcgtccaaaaagatcgcctgggcgtcttggttgagggcggccgctagccacaccaactgttgctggccgccggacagggtcaaaagtgggcggtcaaccaggtcggttaagcctagttcggccaggatcgcctcccccttttcgtcggtggcaggcaagtcgctgagcagcgattggtagggcaggcgccccatcgccaccaggtcgcggaccttaatttcgtcgtaaaccgggttatgctggtgaacgatcgccacctggcgggcaaactcccgcggcgaataggcccagacgtcttggccgtccatggtcaccgtcccggactggggcttttggctgcgggtcagcagcttaaagagggtcgatttccccgaaccgttggggcccaccaggcaagttaattgaccggtcggcaccccgattgtcaggtcttgaatcaacggggcttgatgcgggtaggcaaaggtcacgtgatcaagcttaaacatggcgggcaccctccttcttgtgggccaaaatgaagattaaaaccggccccccgatgatcgctaacaaggtggcggccgggatttcgctcggctggatcaccaggcgtccaatggtatcaacggccagcatcaaccaggcgccggccagggccgcaaagggcaccacggcccggtagtcacggcccaccagcacccggccgacgtggggcacgatgatcccgataaaggcgatcaccccgatcacggcggtcgatgtggtggctaggaaaacggctaacccgagcagggccaagcgtaacttaccggccgacagccccagggagcggagttgttcgtcagacaccttgaggtagttaccccagttggtgaccaagaccaccccgattaagccgaggatcccgagcacggtcacggtcaagcagccgagccaggtcaccgttcctaacgacacctggctggtcgacgaaaagacgctggcgatcccggtgaaggtggcgtttaaggccaccccgatcaggattaggcggtatgggtccatttgcggttggaaaaagattagcacccctagggcgagggccccgccgacaaaggcgaagacgaccttgccaaagaaaaaacttggcaacaaaagtgccccgacaaaggcgaacaaggcggcgccggctgaaacccccataatcccggggtcggcgatcgggttgcgcaaggcggcctggaagaaggccccgctgactgacaacatcgccccggccatcaaagcggtgatgatccggggcaggcgaatgttaaagagggtgttggcgtcggtggccgtcatcttcaagaggctgaagtggctggccccgttagtcagggcgatccacaccgtgaccaccaacaaaacagcgagaacgaggtaggaaatagcggaacgtttcatcttacttacttgggtacagccactgactgacctgctttaaggccttggcggcgttcatgttggccgaggcgttaaaggtcggttgctggaggtcgtaaacccgcttgtttttgaccgccggcatcgtcttccaaaccgggttggtggagaattctttttcgaattgtggcttggtgacgtttggcaaggcgtgttccaagcgcaagatcacgtccggcttcttggtcgccaaggattcgttgttgggtgaaatgtaggtctggccgttagcggcgtagacgttttgccccccggccagccgaaccaggtcgccgacgtaggacttatcggtggcgatcatgtaaccggcccccggcatccccatcaacaccagcaccttcggcttttgaccgtggatccgctttttgacggcggtaatggcgctattaatcttttcgatctgggcctgggcctggctggtgcggtggtattccttgcccaggctggtcagagtccccttcagttgggcgaccgtgtcgagtttaaggtaggtcaccttcacggcctgttgcttgaaggcgtcgttgtactggtcctttaaggtcgaaacggcgtaaacaacggtcggatttaaggaagcgatcttttcgacggacgggtccatcgggctcccaatcttggtaacgtccttgtagcggctcggcaacttagcctgagtggttggcaccccaactaggtcgatgtctaacttgtcaaagatttcggtaatcgcggcgctggtggccacgatccgctggtttttagcggcttggtggtcaacgaaggccttgaccccgacggccaccccaatcacaaccacgagggcgacgagcaaagagataataattgatttcttcttcataacgatcttttcctttagtggcgcggaatttgcttcttagcggaccaaacgaagtagacggcggccgcaatcacgatcaggagccccaggatcccgccgactaacacgaagtagtagagggtctggttcttttggctttgttcttggacccggtcgttttgggcgatcgtggagcgggccagccggctttccttggccttggcagccgacgattgcgaggaggcctgcgattctaactttttaagcttttggcttagctgggggtcgttgctaccgctggtcgaacttgacgacccgttggccacccccgccgccgcggtggccgaactggaattggcgccgctggcactggttgaactagtgctccccgacagggccggtaaactggaggtgtcgaacttaaaggaaatgttgtggttggccttgtaaacccccggtacgttgatcgagatgctgctggagatcaccccgcttaagtccttggtggtaaaggagtagctgtacaggtagtaaccgccgctctgggtcttagtgacgttttgcggggcttggccgtcgatggagttgacgacgaccggccaggccgataggttagtggcggtccgaatggtcatcgtaaccacgtaggcgccgtttgacaccgttaccgtggcggggcgggcgtaatagccgtccgccatcgaggtagtggaggtgccgtacttgtaggtttggtaactaacgctttgggcgtgcccgaccttggcgaagccgatcaccgctacgatcagggtgcacaccgttaataaaaattgcttaagcttcatgaattaatccccttacttttttcacgattcgttgccgccaggtggtcgccaccccaatcacaattagcgccgccacaatgaagaaggttaaggcggccgcaattgggtacttaatcagcgaggcttcgaccatcttggagacgccgggcttgaccgcgtacttgccaagcttcttttgggccgcggccaggtcaaagttttgcaccgtcccggtcccgctttgcagggcggtggccattgggctggcactgccggcgagcggagtggcgctaccagacccggtcaacccggtgctggttagggtgcccccggaggtcccgtcgcccgacagcgcatccaggtagctcctggtgttcgtcgccgtcttgccaaagaccagccaaatcgagaaggtctggttggagatgttggcgatcggcacgctcatccggatcgaagcggcaaccggattgtctagcacagttgggtcggccacgtagaaggtgtaagtccagatatcatcgccgccactgctcgtcttggtggtgttaacgatcggaccggcgcccacagaaagtggcgtaaaggaaacgatcccgctcttaaccttgaccgtcagggtgacgttgtagccactgccggacttggtgacccgggcagtgtgggtgtagtaggcgttggcctcagacaccccggacttggcggcgtttaagacctcgtacttcacgtcttggacttccttggtggtatcaatggcgtgaccctggttggtgattggaagcgtagggttacctttatcgccatcggtttgttcttttttggcgccttctttaattgtgtccgctgattgatccttacccgggaaaacggccagcgccgtttcgttcatcgcgcccagcggggtctgcaaagcaaaggccagggtggcactccccttggccaagacggcggcgctcaccttgtaagtgtaggtcccggtatcgccgttagcggtcgtggccgttggctgttcgccgttgaaagtcatcgacttgatgtagccgttcccgctggacaaagtgaaggtgatcaggtagtcattgccgtcttgtttaatcgtcacctgcttggcaaagaaaccggccgaagcagattgctgggtcgggtcactggacttcatgatcgaaaggacccgggtttcagcgttatcggtattggtggccgaactaggctgggtcgttgacgtgttcgaactcgccttggtggaactagcttgggtgctggaactagtggcactggagctagccgttgccgacttggcgctcgaactgctggagctagccgcactagcactagcgctggaagctgaactagcagcactagacgaactggagctggccgtcgcctgggtcttaacggtcgaaaagtcgacctttaagtaggccttttggctcatggcccccatcggcgtgttcaagttcatgtcgatcaggtagctaccgctggtgttaggcagggtaaaggtgatggtggcgttgttgccgtcgtggtcgatcgtagcgtactcggtttgcccgtcgactttcatatccttaatgtatttacccccgtcgttggtggtcgtgatcttcagctggagcttaccgttttccactactagcgtggcgcccttatttaaaaagccctgggccagggagtcctggttctggtcgtcttgctttttaaaggacgtctgcacgtcgtaagttccatcctgatacttctgatcagcggccttagccaccaggggtgtcgtgcccagtgttaccacggcaggagcggcgatccccacagtgagggtcgccgccattatcgcttggatcaaatgataaaccaatcgtctatttgttaacattgttataacttcctccaaaatgacaccgtgtcacaaaatgttgatttgacaacgttttgaaagggtcattccctcaattttcgttaagatcatgataccattttttgcttttttaatgttgtttttattaaatttatctgcaataattagagcagtttcaaaattaataatcgatcaattcgggaggatttgtccatgacttcacacgttaaaaatactttggttaccaccgctgccatcgccggtgccctggcagccactaccctattcaacaccaccacggttaaggccgacaccaccagctctgcaccggtgaccaccacgaccagcgccaccaaggacacggcgatcgcttccgctcaagccaaggtgaactccgcttccgccgccgttgtttccgcccaagcagcgtacggctccgcttccacggcggcttctgacgccgctgccaagactgccgccgcttccgctagtgccgctgctacttctgctgctacttcttcagccgtagcaaatgcccaagccgccgccgactctgctgccaccgctaagtccacggccgatgctaaccttgctaaagctcaatccaccgccgccgcaactagccgtgctaagtccatgacttcggcagccgttgttagcgcccaatccgctgttgcttctgcctccgctaaggcatctgacgctgacagcgcggtggcttccgctgaagcaggccaaacggtaaccgccaacctgatgaagtccgatgacccaacccaagcttctgccgctcaacaatacttcgccactaagacggcgatcgttaagctcctccctagcggccaagttcaaatcaccattccgctgaccagcgggctggagtacctaaaagaagttagctacaacggggtagacgccaccttcaccaagacgggcgaccactccgccaacatcacctttactgccgacccggccacttcctacaccctggccatgacgatggacatctcgagtgtcatgccattcatgccaatcatgcacgaaacggccctcttagacgttgataccaccatcttcaacggcttgctggctgctaagtctgccgccgacgctgccctgaccagcgcccaagctgctttaagcacggctgaaaccaacgccgctacggttgcccaagttgcttctaaggctgcttccgctgccactgccgccgctacggttgcttccgacgccgccgttgctgccacgagtgctgctaccaacctgaccagcgcccaagctgctaacagcaccgctcaagccgctttgactagcgctcaagctgcccaatccgccgctgacgctgtcttggcagctgctaaggctaacttggacagtgccaacgccgctttaaccagcgcccaagctgaactcaagtccgcccaaaacatcgtggtggtaacgccagcctccagcactgcatcctccgcttcctctaccgcatctagcgcgggttccgctgctagtgccgcaaccgccacttccaacgtggcttctagcgcttcaacgaccacggtaactagcgccgttatcgcaactccggctaccactaagaaggcaacgtctagcacccctgcttcttcaaccactgctaagaccctgccacaaactggtaacgaaaaccaaagcgccctggttgcccttggtttagccatcttaacgctggggatctacccaatgatgaagcggaagcacgcttaataaaggagtgcggaccaaccattggcaggtcgtgggctaaggatagggcacaggttagcgcagtacgcggtgttctgtggccggacttagccactagacctgcggttgaggagcacgttattggaagtgcgacccaaccattaagcaggccgtgggctaagctaaggcaaatggttgtcgcccccggcggcgttctttgcctgtacttagccactaggcctgcggttgaggagcacgttattggaagtgtggaccaaccattaagcaggccgtgggctaagctaaggcaaatagttgtcgcccccggcggcgttcttgcctgtacttagccactaggcctgcagttggggagcacgttattggaagtgcgacccaaccttcccaaatgaaaaacgcccgttccgtcagttttgacggggcgggcgttttttgcttattaagtaacagaagggcacggtaactcacctaacaagccgggccacaaaaaaggccccaattcactaaagaattgaggtcatcacgttatcggtttcccaaagcgggactgatggtattaatgatgagaatttccttcgctggtcctaaccagagcaggttcaatgggtatttctcagccaaacggcaccccaattcttcgtgtctagtgtactacgtctggttaaaaatagaaagcccttacttgctgagttggtcaaagcagaccagcgccttgcccccgtagaccgtagccgggcccccagccatcatgatcgccacgctaacggcctcggcgaattcttcgcggctagcaccggccttgatgcaagcggcggtgtgctgggtgatgcaaccctcacagcgttcgaccaccgaaatggatagcgacatcagttccttagtcttggtgtccagcaccccgtcagcaacactggcggcgtgcagggcgccaaagcccttcccggcctcgccgacactggcaaacaggttcttgttattggcttggcattcggcgagttgttcttggtaatcagtcatggttaaaccctcctttgtttgataccttcaccatacccctaattaataattttgtaaacgcttccctgaattaacgacaccctcaaccgtggtacaatcgacggagttaacctaactaaggaggtggccactaccggctcatcagcctgtcgatcggcggttcctttttgtacctcggtttaatttcgacggccctggctttcgtgttgtggaaccggggcgtccaaatgcttaacgccgccacctcgggcctgtacttcttattccaacccgtcgttggctccctgctaggctggctgtgcctgggcgaacaaatcacctggtcctttttgctgagactggtcttggttgccactagtatttgggtttcgattcgctttgcagattaaataattaaaatagcaacgccccgctggagatcttttccacggggcgttgttttaaattaatttaagtaaatgggtcaccagccccgagtcgtaaaagacgtagagcccgaccccaatgtagcacagcttcatcagccattcgccgtaacggtcaattagcttggtcaccgtggcctgacgttcaacggccttaactaaaaagaccaccaagatcgtcagggcgcccaggtataacaaagctcggccaaagaccgccactgattcgccggccacgaccggcaagaaaatcgataggttacagcccgcacaaacggccaggtaggtagctaagacctgccaggtgccgtgggcggtcgttagttcggccttgtcgtcatcatcctcgtcgtgaagggccatgtagatcggcaagacccccagtaccccgagcaaccactccggcaaaaactgggctaagaccttaccggccaagaagctggccaccaagagcaagaccaccccgctcaagtagccgaccaccacctggcggaccgagaatttcttcaataaaaacagcagtaacacaaaaaagtcaaggttcaccgctaaaaaggtgaccgtcaacagccaaatattcaattccttcgctcctctcattccccttcattattcctgaccaaccggcaaatgacaagggtataataatctggtcacggccatgacgggtgttttattatggttaaatgaattggatcccacctagtctcgttccccctgcatcgtcggcgccgtactagcttgccggttcaacaggaagtggccggccaggcccaacccgaagccggcaatcccaaaggtcagccagccaaagccgaggttgaaaaacggcaagaagtgactggctaggttgatcaaccattgagctgatgcggttgcccgtaagatggctggtaagttgttcaccatgtcgaagaaggccgggatcagggttaacccagtggtcagccggtaaaccaagcggtcattattaaagagtggcgaggcaattcccaagataatcagcgtgattgctaacgggtagaggaacatcaacaccggcgtcgaccaggtgatgatccggttcaaaccgaggttggccaccacaaaggacaggccacagttaaagagtaaaaaacgctggtaggaaaccttagggaagcgcttgtggaagtcctgggcaaaggccaccaccagccccatcgccgtcgtcaaacagccaaccgtggctagggtggctaacagggcgtcgccaaaggtccccaggtaaaagtgagcgatctgcgccagggtgatccccccgttttcggccattgtaaagtgatgtaagctagtcgctcctaagtaaatcaggccgatgtaaatcagggcaatcccgatgatcccaacggccccacccttggccgtggcaatcgcaacttgacgatcgtttttaagcttaaaggaccggatcgcggtgatcaccgtcaccccaaaggccagtgcggccaaggcgtccatcgtgttgtagccctgcaagaagccgttcgtccaggccgcgtgttggtaagccgccgtgatcgtggtggtggacgccttccccagcgggctgatggcggcgagtaagaaaatggccagcagcattagcaagaagagcgggtttaagaccttaccaatgatggtcgtaatgctggtttcctttgaggagaagtagtaaaccaggccaaaaaagattgccgaatagatcaacagacccacccagttcaggttcgctgggatatgggaggcaaagccgatcgtgtacggaacggtggccgtccgcggggtggcaaagagcggccccagggtggcgtgcaccaggattaaaaagagcaaggcgtaccagtgtccgttgggccgggcgaggtcgtaaatccccttagcacgggtaatggaaatcgccaggagcgccatcagcggtagcaacaccccggagaacaaaaagcccccagtagccgccaaccagtaggcccccgccatttggcccaggtgaaccggaaagatcaagtttcccgccccaaacagcatcccgaaaattaacgagccgattaataggtatttgcgaattgataatgtttgtttcatgagttggtcctccttataaatgcttacgtcagagaacttagctaagttcagatcccgtcagagaacttagctaagttcagatcccaacgaaagaaaaaaggcgccccctcaggtcattaacctgaagggacgcctaagcgtgttaccacccttgatttacggcaccatcgctggccccgcctcaacgcgtactccgcagaatacgccggcgcgattacgggcgcacccgttcgacactcaaacttcgcatcgaccactcccaggctactttcgctcccttcaaaccagacccccttccactcaacggggctcgcttactggtttataacgggagttactctcctgttcaccgtgtttctttcgttgttaacttatttctagaataacggaggggcgccgctatgtcaatcagcaaattagagtcctttaacctaaaggggccggaaaaagctctgttttcccggccccttgctgtattcccgaatgttagacagaaattgtggtaacggcctagtgtctaagcaggcccaagagattattccccacttttcgtacttacttggtttcgacgcccttcccgtcgtattcgtcgatcatgatttgcttcaggtcggcaatcagtggttcttgcgggttagccgtcgtacattgatcttcgtaggctaagacggctaggtggtcaaccaccttgtcgaagtgagccttgtcgacgccccaggccttcaagctcagggttacacccagcgagtgggccaagtccttgatcttgtcgcagagcttgttgatcaactcttcgttggagtcgccggtcaaaccgatcgtgcgggcgatcgttgcgtagtcatcggcggcccggaaggcttcgtacttcggccacgtgctaaacttctttggcagggtggcgttaaacttgatgacgtgtggcatcgtgatggcgatggcgatcccgtgggtcaggccaaactcaccacccagcttgtgggcgattgagtggttgatccctaagaaggcgttcccaaaggccatcccggctaaggtcgaagcgttgtgcatggcagcccgggcttcttcatccccattgtacgaagcggttaagttgtcaaagactaacttgatggcttgcaaggacagcggccgggtgtaatcggaggccatgctggaaacgtaggattcaatcgagtggcacaagacgtccaaaccggaagcggcgatgttgccctttggtaccgtgtccacaaactgggggtcaacgatggccacgtccggcgtcaaagcgtaatcggccagtgggtacttcacgtgggtcttggcgtccgtaatcacggcgaacggcgttacttcggacccggtcccggaagtggttgggatcgccaccatttgggccttcttcggcttgtcgaagcggtaggcccgcttacggatgttcaagaacttttgctttgccccgaagaaggaagcattttcgtcctcgtagaacatccacatccccttggcggcgtccagcggcgaacccccacccaaagcgataatcgtgtccggcttgaagctcttcatcagggcaacccctttttcaaccgtcgtcgtggatggatcggcttcgacatcggagaagaccaggtattggacatcgttttcccgcagcctcaattggtcggtcaccacatcaacgtagccgtgggcttgaattgatgggccagtaacgatgaagacccgcttgatccctggcatatccttgaggtaacgaacagaatcgcgttcgaagtagatccgtggtaatttaatccattgcatgttattccgcctcttggcaattgtctttacgtttagcaaatcgtaatcggtcacgttgtgggaaatcgagttctccccccatgaaccagtccctagggtcaaagatggggtcatccggttgtagatgttcccaatcccaccgagtccggacggggagttaacgatgatccgtgaggccttcatcgccaccccaaattcacgagctaggtccatgttttgggtttgaatggcagccgtgtggcccagtcccccgtagttaagtagggcttcacacttatcaaaggcatcttgttgatccatggccttgtaaaccgacaaaactgggctcagcttttcaccggagagtagttcttgcttaccaatggcattaacttcgacggccaggacctgggtgtcttctggcaccttaatgtcggccatttcggcaatttgcatagcggacttaccggcgatcgggccgttaaccccaccggtttgttcgttaaacattaccttgcgcaacttagcgtgttcattttggggaacgaagtagacgcggttcgccttcaagtcggccttcacttcatcgtaaatttcgtggtcaataacggcagagttttccgtggcacagatcatcccgttatcaaaagtcttggataaaacaatgtcgttgacggcccgggcaatcttagcggttttttcgatataaaccggaccgttaccaggtcccacccccagggctggcttcccggtggagtaagcagccctcaccatgccggggcccccagtagctaaggtacaggcaattccagggttgttgatcaatgcggttgaagattcccgacttggttcgtcaatccattggatcgctccttccggtgccccggcggcgatggcggcatcccgcacgattcgagcggcgtgacgggagcattccaaggcttgtgggtggaaggagaagatgattgggttgcgggtcttcatggcaatgatggccttaaacagcgtcgttgaggttgggttggtaaccggcgtgattccggctaagaccccgagcggttcggcaaccgtaattaactcatcggccttgttgtcttcaattaccccaacggtgtggtccttgcgaatgttgtgccaaatttcttcagtcgcaaacatattcttgatcgccttatcttccacgatcccacgaccggtttccttgacggcttcgatcgccagttccatgtgcttatcttggccagcctcgaccatttggtgggtaatgtagtccaccttcttttggtcgaattcgctcatgatatcgagcgcttggtgggccttttggaccaggtcgtccaccatcttttcggtcttcgtcatcttttgtggttcactttgcttcgccattttaaagcttcctcctcaggttttgtgaagaaattaacttgtttacggttataagattaatccatttttgtgatttagtcaacaaggttttttcccttatataacaaggtctaatggctttttattggattgattgtgaattaaatttcaagacataaaatcgttaacccgtcttgtaagtaagaaagcgttttcaagattatgtgaataattgaatttgtttactgaccaaaaaatattggtctaattttacccaccaaatacctttgggccgcccctagctcccggaagaaaataaaaaaggtcgggagaaaacaggcttctcccggcctcttactttattcatgaatgttataatcgcaagccaagtgcctaagaaggccgaaaaatggtacgtaacgccttagtcttcgtccgaccttacctataatcttgtcaggagggtacttcccaaccgctcagccatcatttcattcgtttactcctcaccccggtcggccgccagtaggtgacggtaccgtgcggaactgacttccaattctgccggggtcccctgcatggcgaggtgaccatcttcaatgaagaccacctgatccattttagcgaccccctggaggtggtgagtaatccagattagggtcttgccctgtaactgggtcataaaggtgtctaagacctcctgttccgtaaccgggtccagcccgaccgttggctcgtccaataggatgattggagcgtcttttagcaggatccgggccagagataggcggtggcgttccccaccggagaagcggaggccggcttcgtcaacctgggtctccagcccctggggaagcttcttgatcatctcggctaaccccacccgttcgagcacgtcccacacctgctcgtcactggcgttctcattcccgatccggacgttattggcgaccgtcgtattgaagaggtgaggtgactggttaatcacccctacgtaatcggccacctggtcgcccaacgtggccgtagctaccccgtttaaggtgatttgccccttggttggtgttcggtccccccgcaacagggcggcgagggtggacttcccagaccccgaccgaccaagaatggccagcttttggccgggcgtgattgttaaatcaataccacttaagacctcgcgcgttgtttgcgggtaggtgtagtggacgtcttcaaccttgaccgtgaacgggccattcagggccacggcggtttctggggtagcttgtggcttaggcaggttatttaaccgttccaaggaatcggcgtaaatgttggtttcctgggccgcatccggtaaaccggcaaaggcgtcgaccagtggaaaggtcgctaagacgaaggcggcgatccagttagccgggcccccatattgcccgccaaagtaagtcccggcccacaagagcaagctgaccacgattaggatgaatagcatttgcaaaacgaagttacggaagaattcaaaccggtgcatccggtgttgcaccttcatcaactgctcttcgtgttggttatgcaagttaacgtattcctgcccccgttcggccaggacccagtcggtgattcccattacgttatcggttaggtcggtgtagagatcatttttagtcttcttttccaccgcctgccgggccccgttaatgatgacggaccagagtggaatcgcaaagatcattaggccaaaggtgattagcacccatagccccatcaaaggtgacaaaaagccaatccccaccacgatgatgacgtacaggctccaggaaacgatcatcggaaaaaccgtccgtaagtagaggttttggatgtgggaaacgtcttcggacaagagccccaagatgtcgcccagctggtacttactgttaaagaagacggcgtctccttctaaggaatcatacagcttcttgcgaaaggccgaggtcatccttaacacccagttgtggctgaccagccgttccacgtaacgtagggccggccggccaatcccaaaggcccgggtcaagacaattggtacgtagatcaagaggatgttatccgggtgggtggcggcctttgaaatcaggtaaccggagtcaaacatcaacccggccccacagacaaaggttaataccccgagcgtcagggctagccacagggtctttttgtagtaatgcaaaaaggggcgcacccattggtcatttttcaaatcccgtaagagacgaactttattgaacatcttgctccccctctcccttcgtttgttgaatcagcttggtgaagtaaccattcttggccaacagttcttggtaagtcccctgctcgaccagttgaccgtggtccatcaccaagatgtagtccatcttcttcatccagtgcaaccggtgggtggcaaagaagaccaggcggttttccatcaacggtaacatccgttcctttaagtctagctcggtttcgatgtccaagtgggcggttggttcgtcaaaaatcatcacccgccgcttgtggtccaaaaaagcccgggccaacgcaatccgctgggcttggccaccggaaagggctcgtttcccgcccccaatcatggtgtctaagcccgctggtaggtcagccaacaggtcatcgagaccaacgacgtggatggcatccttcacttcttcatcggaaacccccggggtataaaaggcgacgttatcccgtaagctagcggcgaaaacgtaggggctttgggggatgtaggtgatttggtgttgccaatcggcgatgttcatcgtcgcactagtttggccctgaaacttaatctccccttgctcaggcgttaaaaatcccgccaagaggttaattaaggtggtcttaccggaaccggacatcccgatgattccgaccttttggtagccacgcaaccgaacggacaacggggcaatcttgcccccctcgtggtaacggaaggccaggtcgttaatttctagctggtcatcagcttgccaggcgtgcagcttaaattctggtgcgggggcttgcttttgaccaatgatttccatcacgtctcgaaaggagttcttcccgtccaaggtagcgtggtaatcattggcgaagttgcggatcggtaaaaagtagtccggggccaaaatcaaggtggccagggccgggaaaagcggaatttcggcgtcaatcaagccaaaccccaggtacacggccacgatggcaatcgatagggtggtgaagaaatcaagggcgaaggtcgatagcatggcgacctttaaaacgtccatggtcgacttacgaaaggactcgctcgacttaaagatcgagttggagtaacgcttggacaagccaaagtactttagggtatcaattccccgcaaggagtcgataaagttgttggagaggcgctgaaaattttcgtactgccggtcggcccgggcctgggcggcgtaacctaagatgatcataaagaggatgatgagtgggtagatcaccaacatgatggcggctgattgccagtttaaaaaggctactgcaatcagaatcatgacaggagtgatcatcatcgtcacgatcttagacagggtcagttgcaggtaatcttcaacgttagaaatcccatcgagggtgacggtaaccatactcccggtccccttcttggccaccgcttcgggaccgagtgcgaagactttttgtagcagttgtttgcgcatatccttggccacggacccggcaaaatcgtccaggcgccgggcgttgaaccagttaattaactggcggccaatgaaacacagtgcaaagtaagcaatcggacccgccaccgtctttagggcgtgaccctgccacaacccggttattgactgactcaagaagagtgcttgaccgataatcaaaagagcttgtaggacatcgagtcccacaagccccatgatcattgatcgggcacccggtaatttaaacagggcacgatcaatcattagttactccccccaatggctggcatttcaatccgcttacggaagatccagtaagcccaagccgtgtaaagtaacacgattggaactaagattaccgcagccgtcgtcatgatcaccagcgtgtacggcgacgaggaaccactcttaattaacaggtcgtacgaagaggagatggaagaaaccatcagccgtgggtacaggccttggaacaacagcaccaccaaagcgaccatcgtcaacccgctggaaatgaaggccattccctgccggttggtgatcaccccaacgtgggcgatcacggagaaggccacgattaagaccaggcaaatcagagtgccggccgggtgaagcttcataaagtcggtttggaagatcaacagcagggcgaagaccacttcacccgcgtaaaggacccaataaagcaacttagcaaaactcttggaccgttcgtggattggtcccaccgtcttcaaggttaggtagtttaacccgtgtaggtaggtcaagagtgtcaaggctacccctccaacgagcgagaaccagttgaagtagtcaaagaacgtggcgtgcatgttcccctgagcgtcaattggcatccccttaatcatcgagatgaacagggtcccgaataagaagggcacaatgaaactccccaaggccaaggtggtgtcccaaacatgcttgtacttagctgggctcttagcccggaattcaaaggaaatcccccgaataatcaggccaaccaaaatgaacaagagcaccaggtagtaaccggagaacagggaagcgtaccagtacgggaaggaggcaaacatggcccccccggcggtaattaaccacacttcgttcccgtcccagacgggtccaattgtttgaatcacttgtgtacgttcttcatcgttggttgccaaggtcttaacggccattccgaccccgtagtcgaaaccatcaaggaaaaagaagccggagaataagaccgcaattaagatgaaccatacgagttgtaatgctgacatcttagaaggccccctttgcaaacggatcggcggtaagcttttctaattgtccttcttcaacttcgttcgggtcgtgacgaagctcccggcaaaccaaggcgatcatcacggcggctaaaccagtgaagagtaagaagtagacaatgttagaaatgagcagggacgtaacggaaacgtttggcgaaacggattgggcaatcgtgaagagcccgtacaccgtccacgggtaacgaccaaattcagtgatcatccacccggtcgtgttagccaggaacgggctgaaggttaagaggccaaacagccacattacccaacgcttctcgtacattgcggtcctaccccttctggtggcaattagtccacaaagcgataccaagaagagtaagctaccaaacccgaccatcacccggaaactccagaacagggtgttaaccggaacgtagtagctaaccttttggccgccaatcttggtgccgtacttcttttcaagctgagcgttgatttccttcatcccggtaacggaaccagtcgtcttaccgtaagtcagtagcgacaacatgtccggaatgtcaatgcttgcttccgtcttgtgggtcttcgggtcaaccagggccaccacggaccatggcgcctttttacccgtcgtcgtgtaaaccgcttcggtagcggcgaacttcattggttgttccttaacaaggtacttcatttgaaggtccccaactaagatcgtccccaacgagaagatgagcatcatccacatccccatccgcatcgtcttgtggtagatcttcttgttgacgtcggaaaccgtccgcttctttttaagcagttggaaggctgccaacccggtaatgaccgtcgcaccggttaaaagggctgctaatacaacgtgaccgtattcgaataataattgcttgttagcgagcagcgccccaaagttaaccatttcggcccggccgtttttgatcgtgtaaccaactgggtgttgcataaaggagttggcagttaagatccacagggccgaaacggtcgtcccaatgaagaccatccagatgaagaagaggtgcaagcccttctttacccggtcccaagtaaacatccacagtccaatgaaggtggattccacgaagaaggccatcaaggcttcaaaggctaacggcgccccaaagatgtcccccataaaccgtgagtaatccgaccagttcatcccgaactggaattcttgaatcaaaccagtaaccaccccaacggcaaagctcaagaggaaaatgttcccccaaaacttggtcatcttccggtaggctggatccttggtctgaacatagcgcgtttccatcacggcaacaacgaagaccgttccgattgaaaacggaacgaagaaatagtggaaaatcgtcgtcatcgcgaactggaaacgtgcaagactaacaattgtcattttcagttcctccccaaatgataggcggtgataagttcttatcacctgttaataataattgcttcttccactaaagaatacaccagatcactaatcatttcaacgactgatttttcataatataacgaaattaattaccacgaaggctaaggggacgccttgaaggttctcttagcgacaccataaaaacggttatggtttagcggacgatttgttcatttttatattaatgatcattcgataatcaaatatcacttttagacaaaaacgagctagctattcaacaacacccctttactacccgctaacccatttaacatcgtagtcatcactatttctaattaactgacggttttgattaccgatcaggaaaaccaagcctcttttcttaggcaacaaaaaaacactcaccaaagctggtgagtgttttaaatgatgcttgattacttaagggtaacggaagcaccaacttcttcaagcttagccttgatgtcgttggcttcgtcttccttaacgtcttccttaacgttagaaggtgcaccatcaacaagagccttagcatccttcaagccaagaccagtgatgtccttaaccaccttgataaccttaaccttagcagaacctgcagaagtaagttctacagtgaagctgtccttagcagcagcttcgccaccagcagcgccggcaacggctaccggagcagcagcagaaacgtcgaattcttcttcgattgccttaacaaggtcgttaaggtcagagatagaagcttccttgagggaagcgatgatagcatccttatcaaaagccatgttattttcctccaatatttaggtaatgaattgtgttaatggtcgatacgataacgtaacgatgacgcttaggcggcttcttcgtcgcccttgtcggcaacggccttgacagcccgtgcgatcttgcgcattggatcttgcaatgcggaagcaagcatggacagcaagtcttcgcgaccaggcatcgtagcgtattcgttgatggcgtcgagcgtttggaccttcttttcgatgatcccacccttgatttcaagggcatcgtgatcatcagcaaacttcttcaagatctttgctggcgcaatcgggtcttcatcagaaaaggcaacggccgttgggccaacaaaggtagccttcaggtcttcgtagtcagtcccttcaacggcccgttccaagatcttgttcttgataacgctcatcttgatgttggcgtcacggagttgcttacgcaagtcagtgacttcttcaacagttaaaccacggtaatcaaccacgatggcggattcagcggccaacagttgggcgttaacggacttgacttcttccgccttcttagcgatagctgcttcactcatgaaattacacctcctacatgttagtttgattggaatttataaaaaattccctatgactggcagacatagagaaggaacatttcatttcttcctcggcagggtattgaggcttgcgccacctgagtcttaggcagagtcatatttaatcaactcccctaggataccaaggctcacctttaattgcaagtcttttttgattgttcagcaaagttcgtttcctagcggtgaaaatttcatttcttcacttttactaacaaataaaggcgaactttattaaatatctacactagattgtttttatctatgacctttgttaggatagatttatctaatattaacaatttttccagattacgcataaggaggttcatcggttatgcaagaacaaccacaagaagagcttaagcgatccctcggtttgtggtcggccctttcaatcgtgattgggacgatcatcggctccgggatcttctttaaacaaggggccgtccttgactccgccggctcttccaccatggctattttcgcctggatttttgggggcgtcatcaccctggccgccgggcttaccatcgccgaaatcggttcgcaaatgccctacaccggggggctgtacgtctacatcgaaaatctgtatggccgaatctggggctttttagccgggtggatgcaagtcatcgtttatggtcccgccatcatcgcttcggtggctggcttcatggcaatcatgatgaccaatctctttggcctctccagcgactggcgaattcccctcgccctgatcacaatcctttttatcggggccttaaacctgctcgaaaacaaggttggcgccgccttttccgttatcaccaccgccggcaagttaatcccgatcgctgccatcatcattttcggtttgctttggggacaccacaatgcctttgggcaaaccgtgggtcaagttagccaggccgggggcggcttcggggtcgccgttttagcaaccctctttggttacgacggctggatcttgatcgctaacctcggtggggaaatgaaaaacccccaaaagttactacccaaggcgatcgtgatcgggatcaccgccgtcctcgtcatctacaccttgatcacggtcggggtgctgcgtttcttaccggccataatgatccacaaacttggcgataacgccacttcctacctcgccacggccgcctttggccaaatgggagggaagctgttatcaatcgggattatcgtctcaatgatggggacgatcaatggtaagatcctgacctttccgcggatcgtttacgccatggctaagcgccacgacctccccttctcccgccccctttcctacctaacgcctaagtcaaagagcccggtggtggccaccctgttcatcatcgtcttggccactattatgatgctcttctttgaccccgatcacctgtccgacctgtgcgtctttacggtttactgcttctacaccctggccttttttggtatcttcattctccggcgcaacaaactggtcaagcggcccttttcgaccccgtggtacccgttcgttccgctggtcgccattgccggggggatcttcgttttaatcagcgaaatctttaacgatccagaaggggtgctcttatttatcgggatcgtggtcgttggcctccccgttttctacctggttaaaaaaatcgaccggcgccatgaataactaggaacaatcaattaccgaatcacaactttaaccaaaaatagctggggcgtgccgctttaaccacggctccccagctattttcgttttaaccaaccaagagctttaccagtgatggtaaggctctttttttgttttccgctatgatagaaaaacgatgcgtaccgcatcaaccgccgtcctagcttagcccaatggcccgggcctgcctcggaggttggggcgcacttccattttgcgcaaatccaaacatttgtcctgtctttccccaggtctagaaaggaaattacattggagaccgattaagtgcgagcaccgtagcatgtagcataagcatgcaagtttaaatccggggggacgaactgaacaagaggaagggcgttgccaagttaatcacaagtgagcaatcttcacaactgaaaacgattgcaatataatgaaaccattgatagatcattaggaatggatagtgaggaggctcataatggcaactgtatacatgacggcggtctttccggacgtcgcaagcaaggtgttggatgaagcggggatcgaccacgatggttttagtggcgaaggcctgatcaccaaagaggaactactcaagcacgtgggcgacgtgaaggtcttgattacgccactgtcaaccaaggtcgatcaagacgtcatcgatgcggccccaaacctgaagctgatcgctaactttggggctggctttaacaacatcgataccgcctacgcccgcaagaaggggatcgacgtgaccaacaccccctttgtttcctcggtggcgaccgctgaaatcgctagtggactagcaattgccctatcacggcggattgtggaaggtgaccacgtgatgcggacggtcggttttgatggctgggcgccgctgttcttccgggggcacgaactagcgggtaaaacgctagggatcgttggcttaggtgatatcggtaaaaacgttgcccaacgcctggctgcctttgacatgaagatcctctacacccaacgtcaccaggccgacccagcggtggaagcacattacggcgccacctacgttagcctagacgaactgctggagcaaagcgatattgtgtccctgcactgcccattaacgccggcgaccacccacatgatcgcggcgccgcagtttaaacagatgaaggacaacgccctgttgatcaactgtgcccggggaccggtcattgcggaagccgacctgttagttgccctcaagaaccatgacatcgccggggcggcccttgacgtttacgaagcagaaccagaagtggcggacgaatttaagcacctcgctaacgtcatcttgaccccgcacatcgggaacgcctcctatgaagcgcgggatgcgatggctaaaatcgtgacgaccaacgccgcccgggtgttagcgggtaaacaaccacaatacgtggtaaacggaaataacgactagttaatcaattcacaaaccatggtcaaaactaccaaaaaagccggcaagctttgttcactgcggacattgtattgttggctttagttttcaacaatgattaaagagatggtaccaatgacaatcgttggccaacttgttggttaacgcaacccacaaaggagtggataaaatgagtgacttaacaattaaagaacgcccgattatgaccccggggccggtttcaatcgacccgcgggtttcctaagccatgagcaaccggatcttaggccaatttgatcctgatttcttaaccatcatggacgacacgatggaactgacccgccaagcctttgaaacgaagaacaagtgggcctttgccgttgacggttctggccgcgccggcttagaagccctgatgagcaacatcatcagcaagggtgacaaggtcttagttcccgttttaggccgtttcggtaacctggggattgaactcgcacaacgggccggcggagaagtcatcaccatgtaaaccgagtggggaacggtgtttgaccaagacgaaatcattgctaatattaaggaagttaagccaaaagtggtggcaattatccacggggaaacctcgacgggacgcctgcaaccaattgaccggttgggggccgccgtaagagaagtgggcggtttcttagtggtcgacgcggtggcttcctttatgggagcgcccgttaaggccgacgaatggcaaatcgatgccgtcgtggggggctcacaaaagtgtttgggtgccttaccggggatgtcattagtgacctttaacgaccggtttgcggacgaaatcaacaagcgtaagcggattgaattaggggtgcggggagaagacgcccaaaccgccgctaactttgtcccgagcaactaccttgatttaacccagctacaagactactggtcaccagcccgggttaaccaccacaccgaagccacgattggtatctacggggttcacgaagccctgcgcttaggggttcaataagaggggctggccaaccgttttgcccgccaccagcaagtacactaagccttaaacaacgccgttaaggccctgggcttaacgatctttaacgagggggaccacgaaatgccaatggtcacctgcgttgagattccggaagcactacgggacaccaatttccaaagcgaactcttaaccaagtttggggttgaaattgcggcctccttcgggagtttgcaaggaaagatttggcgactgggaacgatgggctacgtggcccaaaagggttacctagttcgcttcatctccatctttggggccgccctcttgcaagcgggctaaccggctgacgtgaaggccgccctcgacgcggtagaccaagccttcgcataatagtattacgataaacgacaaagccccctggtttgcagttgcaaactggggggcttttttagctatggaaaccgccggcctagtggctaagtccggtcacagaacaccgctggcgcgctaacctgtgcccgaaccttactacggcctgcccaatggttgggtcgcacttctttattccaagaggtcagcctggttttcgtcggcggacagttccagggccaagcgaatgttgagactggtttgggggtccttaatggtcttgcccaggattttttcgcactgcttgatccggtacttgatggtgttgcggtgcaagaacaagacggtcgcggttttggtgatttcgcagttataactgaggtagcaccgtaatgtcttgcgcaggtcttgcatggccggttcgatagggaaggcgaggttgcccagtaccttttcgcagtagtagtggatccggtcggggtccacgtcttcaaataagccaactaaccccttggggtgatagtagttgacgatggtgggcgagagctcctgggggaagtcgcggaccgccgttcgggcctcgatgtaggagttggcaatcccagacaggcggtcgtaggagttgccgatcgaaaagcggaggtggatcccgacggccttacttagttcggtggagaggttggttaaaatccgctcggtatcccgggaaaaggactggaagataaggattagctcgtcgctgcgcgttagcttaaagataatgacgtcctttaagtggcgggggagcttttcttggagccagcggttggccacctgtggggaccgctcaattgacggcgactttgaaaacgtcgacgactactccctttatgaagggatgaagcaaatcgccaagacgggcaaggtgttagcaattcacgccgaaaacgccgcggtgaccgaccgactgggcgaaattgctaaggccaacggggaaaccactttggccgcttacgttgacagccgcccggtcttcaccgaagtggaagccattcaacgtgccatcctcttctctaaggaaacgggctgtccgatccacatctgtcacgtggcctgcaaggaaggggtcgacgccgtggttaaggcccaagaagaagggatcaacgtcacttgtgaaacctgtgttcactacctctacttcactaaggacgagttagacgccattggcccggttgtgaagtgctccccgccaatccgtgaacaagcccaaaaggacgccctgtggcaacgggtggaagatggtaaggtggcctttgtgacctccgaccactccccatgtacgccggacttaaaggataccgacaacgcctttgacgcctggggtgggatttccggggttcaaaacgacgttgacgtgatgtttgacgaagccatgcaaaagcgggggatggccttaaaggacttcgctaagttgattgccatcaacccagccgaccgctacaacctgacccaaaagggacggatcagcatcggtaaggacgccgactttgttttgatcaagccaaacgcaccgtacacgctgacggcggatgacttagagtaccaaaacaagatcagcccatacatcggccgtgaaatcggggcgcaggtcgttcaaaccatcctgcgtggtcaaaccatctacagccaagcggatggggtgaccgccgacttccctggtcaattcatcaagtaagttgttggaaaggaacgttaaccggtaaagcaaacggtccgttcctttttttcagcgctcgcccgccacggcgaacaaagaagggttcgtttttagttaaagtgactaatgaaccggatggtgaaaccgaatacaatgatcctgaaataagcacaaggagggctcaggaatggaattagcaccaaccgtaaagcgccgcctcgaccagctgtcatcaattggcagcgacccaaccgggggcttgacgcgactgctctactctgacgagtggttaacggcgcaaaaatacattcaagaagagatggcggccatgggaatgaccaccaagtttgacggggtcgggaacctgtttggccgcatcgaaggaaaggacctccccaacgaaacggtgatgacgggttcgcacatcgacaccgttgtcaacgggggaaatttagacgggcagtttggggtgctggcctccctgacggccgtggagtacttaaaggaaaagtacggtcaacccaaacgatccttagaagtgatttcgatggccgaagaagaaggttcccgcttcccgaccgttttctgggggagcaagaatttcgtgggcatcgccgataacgaagaggttaaagacattaaggatggtcagggtaagggctttgtcgacgaaatgcgccgccagggctttgacttccaggaacaaacccgccgcgatgacatcgtcgcctttgtcgaagaacacatcgaatacgaaggcatgaaggacgtcttgttatgggacttcttgccaaccgatgacctgggctttgacatgaacgtccacatcctctcctttgaacagggggcaagccacgcctacgtggaaacccactaccaagaacacggggcctacctgatcagcgggcaagggatgcacaacctagacaacgaatggtacccggttgaaaagggtgattacctcttcatgggttcctactccccgcaagccgcttacgccgttggccggggtgaaccgttggccggggtgaaccgttggcctacgtctactccaaggatgctaaccgcgacccagaaatttaactgacaggaggagttaacgatggcggaaccaggaatcaccttagttgatgcagccgaactcaaggaattaatgaaaaagaagttcatggccgcgggcttaccggaagcaccagccgaggaaacggccaagcacttaacctacgccgacgcgtgcgggatccactcccacgggacggtacgggtggcttattacgccgagcgaattgcaaagggcggggtgaacctcgctcccaacattacgtttgaaaagaccggcgccgccagtgggatcgttcacggcgacaacgggatgggacaatacgtctgcaataaggggctcgactacgcgattgacctagccaaggagagcggagttgccgccgtgggggtggaaaagaccggccacaacagcgggatgctctcttactacgttaagcgggccgccgaaaacggcctggtggcgattgccatgtgtcaatccgatccgatggtggtgccgtacggggggagcgaaaactactttgggaccaacccaatcgcttttgccgccccaaccgatttggaaaagccagtcgtctttgacatggcgaccaccgtgcaagcctgggggaagatcctagacgcccgctccaagggcaaggcgatcccggacacctgggccgtggaccaaaacggggacccgaccaccgatccaaacgaagtggccggcctgttgccgattgccgggccgaagggttacgggttgatgatgatggtcgacgtgattgccgggagcctcttggggttaccgtttggaaagcacgtttcctcaatgtacgaagacttaacgcaaaagcggaacctgggccaattctacatcctgttggatccggcccgcttcaccgacccggccgccttcaagcaccgggtgggggaaatggtcgcagaactccacgccatcaagccggccagcggctttaagagcgtccgcctgccgggggaaggaagccagatccgctaccaaaaggcaatggaagacgggattgaagtcgccactgagatttacgattacttgagaagcgacaccgttcacttggacatgtacgatggcaagggtgcctttgcttagaaaagaggggtgattagcgaatgctacacacaattattgaaaaaacagttaccatgattcaattgttctgatgcttttgaccaaccacctgaaggaaatcgccgtggttaacaacgttcaagtgatgatggggacccccgccaacaaagacatcttcaagaccgggggcttggccacgccggaattagacgaagccgacctcgccctgcggggaaaggccggcacccagatcagcgtgtataattaattgttgaaatcgctaccaatctttctcctaagtatagtaaaattaataccaaaccaaatctcttgctcacccgagtgggagattttttgtaccctgcgttaggaaaggatgagaccaatggtaaagaagatcattttagactgcgacccgggccacgatgacgccttagcgatgaccttagctgttgccaacccggcgattgacctggtggcggtgacgacgtcggcgggtaaccaaaccccggataagaccttgaacaacgccctgcgaatgctgacgatcttaaagcgccctgacatcccggtggccgccggggcccaggtcccgctggtcaaaccactagaaacggcgcccgaagttcacggcgaaaccggcctggacggggccgacctgccggagccgggctttttgccccaaagcctgccggcgatcgagttaatggcgcgggtcctgcaagaaagtacggaaaaggtgaccctggtcgtgaccgggccgatgaccaatgccgccctgtttttgcggacctgcccggacctggctagggaaaaaattgaccaaatcgtcttcatgggcggggcaatggggttgggtaactggcaacccagcgtcgagttcaacatcttcgtcgaccccgaggcagccaagatcgtgctgaactttggcctgccgctggtgatggtacccctaaacgtcacccaccaggcccagatcaccaagccagaaattgacgaaatcgcccagctggataacccggtggcccaggcctttgtgggcttgttgaacttctttgaacgttaccacgaggatccgaagtggggctttgtcggcgccccgctccacgacccctgcacgattgcctggttgattaatccggccctgtttgacggtgtggatgtcaacgtcgacgtggagacgaccggggagttaacccggggcgaaacggtttgcgattactaccacctaaccggcaagccggttaacaccaagttactccttaaggttgaccgggccggctttatttccctagtcaaagaatcgctagccagttttggttagaaaattagtttgcttttaaaaccgttgggcgtatcctaagaaaaaaagcgcccgccacaagaaaggaatcctcaaaatggaagcacaccaagcactcgaacgccgtcgtagcacccgttggtttttggaccgcccggtcgatccggacgatttaaagacgattgtggtccagggactgcacgccccttcctgggtcaactcccagccctaccacgcccacattgtgaccggagagaccctccaaaggatcaaagacgactaccttgaggccagcaggaatggtaaggaaagcaagccggaactgcccccgacgccactggaagattggtcgcccttggcccagcaaaacatgacccactggagggaaggggtggaacacacccttggtgacatgaaggtcatggaagaggctgcgagccatttgtacaacgccccggcgatcgtttatttaaccctgcccaagaacttctcgccgtggtcattgtatgacctagggggctttggcatggggatgatcatcgccgctaccgaccaggggattgcgagcttaccggcctaccgcttcgtgatctatccggacatcattcgccaacacgttgagattccggaagacgaggtgctggtgctcgggattggcttgggctaccgtgattcctacgccccggtgaaccggattattgcggcccgcgaaccgctgaccgaacttttagactataaggagtaattgtaagccatggctgaccaagaattgttcatgcaaaacatgttgaccgaactaaccacctcgcaacgctttacggaggggaacgcgcccgccttctcccccgaccgggttaattacgacccggcttcgcctttaaatgggcgccgggtggcctttttgggttcttcaatcacctacgggctcttcgccaagggggtttccttcgtcgattacctgcaggccaaggacggtttggtcgccaccaaggcggccgtttctgggaccaccttggccggtaccgacgtcaacggctacttaaagcggatgaaacggcgcttcaacggtcaaaaagcgtacgacctctttgtctgccagctatcgactaacgacactcggcacggggcgaccctgggtgagcgaaccggcaacgaacagcgggagggctttgacctgtcaaccacgctgggggcgatcgaagaaatctgcgcgtacgtcaagcagaccctcgactgcccagtcctcttttacacttgcgttaaccaaaaagacgacggcacctacgcccagctagttgatgaactcaagttgttacaagccaagtgggactttgccatcctcgacctgtttaacgacgccggcttaaacgccgcgaccgctgcccgccccaacgccatgtatgacgaggtccacccgactcaggcgggctatttgaagctgtggttaccggtctttgaacaaaagctcggcgccctgcttggttaggggggcagccatggaatacgaagacttatttaaaaagatcactgcgtgggcccacgaccgcggtatcgaccaggccgacccgcgggttgaattcatgaagatggccgaggaactcggcgaattatcggcggcttataacaaagagcaccacgctaagatggtggatagcatcggtgacctgcaagtggcgctgttgatcttttgccagttggtcggcgtcgaccacaaggaagcgattgaagcggcctacaaccaaattaaggaccggaccggtaagacgaccaccgcgggggtgttcattaagcagagcgacctgcacgattaatgcattctaagcattaattccgatcaaaagaaggtatcggcgaattgcttgtttaatcttggcctagcggggtatgattaataacgtaaatgattaagtgagcaagaagggagcgcattaaccgatgaaaagtgcaatgtttatgaaaaaggggctcgttgaagtccaagacgttgacaagccgaccgttaagaacccagacgatgtcgtgattaaggttttacgggcctgcgtttgtggttccgacctctgggcttaccggggcttagatgacaagccggccaactcaatcaacagtggtcacgaagccattgggatcgtggaagaagtcggcgcagacatcaccacggttaagccgggcgactttgtgatcgctccgttcacgcacggctgtggccactgtccagcctgcttagctggttttgacggggtttgccaagaccacagtgataacttctccaacgggacccaggctgaatactacctggcccaacacgcacagtggagcttggtgaaggtaccaggtaagccggaagactacagcgaagccatgcttaagtccttcttgaccctggccgacgtaatggctactggttaccacgccgcacgcgttgccgacgttaagccgggcgacacggtggtggtaatgggtgacggggccgttggtttgagcgccatcatcgccgctaagctgcgcggcgccaagcggatcatctcaacttctcgtcacgatgaccgccgcgagttagccgctgaatttggtgctaccgacaacgtggccgaacgtggcgacgaagcggtgaaaaagatcctcgccatgactaacggcggggccgacgccgtcctcgaatgcgtggggaccgctcaatcgaccgacaccgccatgaaggtgggtcgtccgggcgccatcgttggccgggttggtttgccacacgacgctaccatggacatggccacgccgttctaccgcaacaccgccgttgctgggggcccagcctccgttaccacctacgacaaggacctgctcttaaaggccgtcttggatggtaagatcaacccggggaaggtcttcaccaagactttcaccctggatgaaatcaacgacgcctaccaagccatggctgatcgtcaggtcatcaagagctacgtgaaggttagcgattaaaaagaagtgcgaccaacctcctcggtaagccgtatgactaagctggggacgaaggttgatgcggcacgcatcgttcttcgtcctgcttaggcactaggcttacggttgggagcacgttagctgaataatcgttgagaaacacaaaaaaccgccgccccacatggggcgacggttttttgtgtgctgattggttgatcgcgttgcttacagttgttgtgctaccgcttggttaacggcgtcggcctggctttcaatcagggcaaccttgctggcaatcacttctttatccatcgtgatttcccgggtcaagcccgccacattttccttgggttcaaagaaggcgttgaactcatcagaccgttgccgggtgtggaagacggcggcggtaacggtgatgaaggtggcaaattccatgtcaccaccgaccgtcttgtctaaccaatcccactcgttgcggatccagtcccaagccagctgttggccggtcgggttggccaagacgccgcggtaccagccgcggaggtcctgcggcttgatggtagtggcgtcttcgaagtggtcaactaggtcacggagttgggcggtttccttggtggcgaccaaggcgccgcgcagatcttgcttgtagcttgggtcgctggtcgtccggtagtcagtcagcagttggtcaaagagggctgatgtgttgaagttttggacttcgttttttaagactaatggccggatggtggcttcgatgctcagtggttggttttggtgatccaagaagatttggtgggcggcttccttggcctgggcgttgtcagcgtacaaggcggcgcttaagaccaacggccgggtcagttggtcgtcgatggcttcgccagccttggccgaccaggtgaggcggctagcttggttcacacttaattgatcgaagaagtgcttcaggttagcttcttgatcgctgcccggaatggtcaagttcttcaagaagttggcgatctggtagagggcggtgttgacgattgaggatgggtcgtccttgaacttggtcaacagcgggaccaaggtggcgtagggaagccgcttcccttcggctaagaggcgcaggtcctggagtagttggcgcttggtgattgcatccagttggccctcttcttttaagatgtcttctaagagggtggcgtcgtagttgacgatgaagtgggagttgttaccgacgttgatccgcagcggttcaccggcttgagcgcgtaattcccggtagtcacccaggtctaagcgggcgtccttcataatttgcggggcggcgaagttagcgttcaacggaatttcccaggtccgcccctgctccttagcggcgccaataaagaattgttcctggcttaagatcaggtgaccgttttcgaccgtggccgctacgaccgggtaacccggttgttccagccaggagttcatgatctcgccgatgttgatgccggccgcgtcgccgagggcttgccataagtcggccccggtggcgttgccgtattggtgggcggcaaagtagttctttaacccttcgcgtagcttgtcgtcaccgagcagggcgcggaccatcaccagcatccgcgaacccttggcgtaaacgatcgccccgtcaaagagggcgtcgatttcggccgggtcattaacggccacgtgcaccgattgcaccccgtcggtggcgtcgcgttgcagagccatcggggcttcggtcgtttggaagagttcccaaatgtgccagtcgggttctaaggcgtctacggacaggtattccatcatgttggcaaaggattcgttgagccacaggtcatcccaccacttcatcgtgaccaggtcaccgaaccactggtgggccaactcgtgggtgataacggtagccacgacccgcttcatgtccaaggcggtgttgtccgggtcaactaaaaggtaggcctcccggtaggtgactaagccccagttttccatcgccccggccgagaagtccggtagggccagttgccaggagtgggggagtgggtacttggtttggtagaagtcctcgtaaaactcgatcgcccgcttggcaatgtctaaggcgaaatcgagttcctttgcttggtgggccttggtggcaaagacgccgaccttgacccccgacgtagtctcggtgacctttttttgtaggtcaccaaaggcaaaggcgaccaggtaagtggacatcttaacggtctcttcaaagtagtggtagccgtcttcgacccgttcttccggcatgttggcgagcaccgtttcgccaggttgctcgtcgaacttaatcgccaggctaaaggttgccttggcttccggctcgtcgatgctagggaaggcctggcgggcgaaggtggtttcaaactgggtgccgatcagttccctttgctgcccgtcgacctggtaataagacgggtagatccccatcattgtgtcggtcaaaggggcggtgtaatcgaccgtgatggccaccggaccggttttgggcagggtgaaggtcagggcctcttgttcatcactggtttcaaatgaaagggtgcgcccttccgtcgtcacactagtcacctgcaagaacttctggtgcaagtagatggtcttggttaaggcctcaccgtcaatggtaacgtgaccggcaaactgctttgcttgacggttaatgtcgagcttgatgtcgtagtgcgttgggtgaaaggcttcataaaaacgggtaactgccatgttaacttacttccttttttgttgataggctaagtatacgcccgttgacgggttcgggggtagtaaagagacgacgaaggggtgggagaccgcattcgtcttccaccccttgtttaattaatattagccggaaatcccgtgactttagtcatgggatggataggtcactattgagcccctttatggggctttttgtttgtttctgtatatttttcattaaaatgcggccgcttcgcaagattgatcttgcgaagcggccgcattttgtgtaggcaaaagttggattgcactttcgataacgtggaaaatgaccacagacctagtgcctaagtacgggcgaagaacggtaccaaggcatcaaccttcgccctatccttagcccacggcctactggataggttgggtcgcacttccgataacgtgctccccagccgcaggcctagtggctaagtctgaccacagaacaccgctgatgcgctaacctgtgttctatccttagcccacggcctgcttgattggctgggtcgcacttccctttagaagtggaagcaagtaatgaaagtagcgaaggagaagaagacccctgggaagttagcccagaaaacgggccagtcacggtccttcttgaagtaggcgtagattgaccacaaagaacagttgaccccggccacgaacggttgcagtggggcaccatattggccgtgtaggttattgatgatttgagcgatgtaggaaacgtacatcaggatggcgatgacactggcgaagcggccaagccaggagatgaacttttcagagtcaaatgagtgttcctttggttgttgcataatgaagatcctttccataagtaaatcctggattcaagtgcttccgccagcatgattgtagattaatgaacaattgcagtatgtgaaagtcaaaagtaggatggcgattgtgcttagaaccaccgcccagtttggtggggtgaactttttgaccttcggcaaccaagcgcagggaatcgcttgcatcgtgaagtagttaccttcttgttaacggttacataataacgccggttataataactttcaaccggttacatatagaaaaaattaaaatttattactcataaaatacaaattttacatatataaactaatttaataggggtgtcaccgttgttatttaatataaaccggtttacacaaatttttagataattgggacggacgtaaaaaattaggtcggattttctagtttagcccacggtccgtcgaggaggttggtacgcacttccaataacgtgctccccaaccacgtgcctagtgcctaagtacgagcggagaacgacgtcagggcgtcaacccccgctctagcttggtcatacggcccgtcgaggagggtgggtcgcacttccaataacgtgctccccaaccgcaggcctagtggctaagtctggccgaagaacggtgcgtaccgcaccaaccgttcgccctatccttagcccacggcctgccaatggttggtacgcacttccaaaacaaaaaagaccaggagcaagctcctagtcttccatcagccggtaaataatattccggtcgttcttcgagaggggacgcccccggtaggttaaattgacgttttcatcggccaggtcgaccgtcactggttgccgaattgaccgttcatggtctaaaaggtaatcagttgatacctcaaacaattctgctagtttcgtgacatatgtactggagggttctgtccggttcgtttcccacgctgtgaccgtggtttgcgaaatgccaatgtatttaccaagcatcgtctgggacaggttccgcccctttcgaaggtgtttgattctagcaccgatcattactataccccaataataagaatgattatcttccatgataacccatggaaaacctaaaagcgctaattattgaaaagtttaatagactttctggactctattaagctaatttaataaaaatgagcaaaaagaccacccagtagactaaatacaacatctgctgggtggttgaattaggaaggttgattagaggatttgtttggagtaggcgtcgacggcccggaaggcttgggcaacgtcacccggttcaacttcaaacggcaggcggtgaagggtatcggtcggggcacaggcgaccttaccagcttctaagagggcttcgtcggaaacgtcggctaagtggaggtcggccaaggtggtcggcagcccgagcgacttgatcaggcgcaagtacttgttgtagcgctcttcatcggcgccttctagcatcagctgggtcagggtaccataggcgaccttttccccgtgggtcagggcgtgggtctcttcaaagatgcacaggccgttgtggatggcgtgggccccggacaggccaccgctttcgaaaccgagcccgctcatcagggtgttggcttcgatgatcttttccagggcgctggaaaccacgttttgttcgacggcggccacggcttggtgagcgtacttgaagagggtttcctcacacttttcggcgattgcgatcccgaccagggtttgcttggcatctagcatcgtgtcggcgccggattgggtgacggcttgggcctccacgttggtggccagggcgtccgcgatcccggcgaccaagaggcgggccggggcgttggcgatcacttggctgtccaccagcaccagttccgggttatggtcgtagaagcggtagttttcgaccgtgccatcttccttatagatgaccgacagacgcgagcacggggcgtcggtggaagccagcgttggcatgatcacgaccggcagcttagcggtatcggcgaccgccttggccgtatcgctggtcttcccgccaccgagaccgtagatggccgtggcgccttggtccttggcgatcgcggcgatccggtcgatttccttggtcgaagattcaccattaaagttgaccaaaatgacgtcgaagccctgctttgttaagtaagcttcaaagtccttgccgacggcttcgtagacgtggccgccggtaattaagaggggcttggtgccgaagctttccaggtagggcttggattcaaagagcacacccttaccttgaacgtaagaagatggggaagcaaaagctttaatcatgtcaattcctccaattagatattgtgtatgttttaacaatatcgataagggcgggggatgtcaagcacccttatcggttttttagtagggggagaataataataaacgcttttcttacacaccggcgtaattctaaaacttcctccaactttccctgttcctaggcaatagtgctttcgtttgccatgactgttccgtgtaacattcgggtgggcggatcaaataagggtaaatgggaaatggatacctatcgtgacaatgaaaaattttgagaatgctagtagcaataagtccaaccgtggtttctcgctgaacgattttgaagaactcccaaaagaagttgagcaggcgatgaaactggtaaaagcggaggagttgggtctagtaaaggaccagagtgagctaggggctggccttgaagcgttacgtcagcggtgatcgtgaggaaagcatacaggacaaatctaaaattgggcgcaaagattagtgttttgaaagtttacacagataacgtgctccccaaccacaggcctagtggctaagcaggccggagaacagtgcgtgtcgcactaacccccggccaagcttagcccaacggcctgtcgaggaggttggttcgcacttccattttgcgcaaatctaaatatttgtccggtgggggtggcaagttaagagaagggcgatcccctgtttaattattaatcagattaacttatggatcactccccaaacgcgaattgatcgtggcggggagctttttacaattaagccatcaagtaaacgaaaggtggcaacacaaatggcaaaagaagtaatgatcgtagtcggggcgggacaaatcttgctggcaatcgcacggcggatgggctacggtaagcaaattctgctcggcgacaagagcgagggaaacgccaaggcgatcggcaaggtcttagaagaggccggttttgacgtcacgaccacggtgatggacctgtccgaccgggcttcgatccaggcgatggttaaaaaggccacgagcatggggccggtcaagtacctggttaacggggccggtgtgtcgccgtcgcaggcttcaatcgaaacgattttgaaggttgatttatacgggaccgccgttttgctagaggaggtcggtaaggtgattgaagaaggcggcgccgggatcgttatctcttcgcaatccggcttccggatgaagcagctgaccccagaagaggaccggcaactggcgctgaccccgaccgaagagctcttggatctgccccttctagccgaggaaaacatcgaaaccaccctgcaagcttaccaactggctaagcggtgcaacgaaaagcgggtgatgggcgagtctgttaagtggggtgcacgcggggcccggcttaacgacattgccccggggatcatcgtcaccccgctggccctcgacgaattcaacgggatccggggcgacttttacaagaacatgtttgccaagagtccggcggggcggcctgggactgccgatgaagtggccgacgtggccgaactcttgatgagcgaccgggcccaattcatcaccggggctaccttcctcgtcgacgggggcgccacggcgtcatactactacggcccgctacaaccgggtctggcgaccgggatggaagaggggaagaagtaatgaccgtctttgaccgcctccaccagggcgaacacattgacattcgggatgccgactaccagcgtgaggtccacggcgaaatcaaccgcttggcccagcgcctgcaaggggaactggaccgcttcttcagtttcatggacctcggtaaagaaaaggagcgcttattgaagcggttggtcgacggcgccaggagcggggtcgcaatcgcgtaggtccaggcaaagaccgagacgatcgaagcgctttggctcagggtctggtggtaggtgtgggcaatcaaagaaaggttgccgacgaccatgaattcgttacacccccaacataaaggagatcaagacaaacatcgccgctaagacgtacaaacgggtgtggttagttttggtgaccatagtatcctcaattccatttcgatttgccgacaggcgtttctttcattgtaaccgctaccgaaaaggttgggaagatgaaaaaagaccccagcagttcacgtgtgaactgctggagccgattggtgcaagttggaagaaaggacgccctcttgattgagttgaccctcgttgttatttttgacgattttgacatttgcctgctgatgctgatcgttgcgctaatcaaacttagcgtaaaaaaataaccgccttagcttgcaccggctagcggttattaaataactaaaagttggccaccgaaatatcggctctacccagggaggcttccgacagcctcccttttatattgttattatagcatgacgaccatgatggtcaaataaaagaacagttacaaaagggcgccaccagttcgcataagaacattgttggagccctttgtttaatcttcaatgtagtttaagcccacgacctgccttatggttggtccgcactcactacttgcccgagtccccgtagttggagaggacgcgagcggacgggtcgtcaacgtcgcaaccttcccagtcgctgtttggcatccagtagtccttgatccattcggccttgcccgggaagaattcttcaaagatgtcgcggtagagcagggattccttggtaaatggtgccttgtaggcgtacttttcgctggccttggccacgtcttcatccgtgtacttggcgtcggcgtattcctttaagtcgtcgaccagggagtggccaacggcgtcggagaaggccgccttttcccgcatcaggatgtcgtctggcaagtagtcttgtccggcaaaggccatccgcaacaggtacttccccttgtcgtagtggttcatcttcatgtccgggtctaaggacatcacgtattccacgaagtcgaggtcggcaaacggcacccggccttcaagcgagttagccgagatgcagcggtcggcccgcagcacgtcgtacatgtagagttcgcggacccgcttcatcgattcgctttggaaggcttcggcgttcggggcgtagtcggtgtacttgtagccgaacatttcgtcggagcattccccggtcaggatcaccttcaggtcggtcgtttcgtggatcttcttgcacaagaggtacatcccgatcgaggcccggatggtcgtaatgtcccaggtttccagggtataaatgacctcacgtagcgcccctaaaacatcgtcgcgagtcatgatgaattcggtgtggtcagtgcctaagtagtcggcaacttcacgggcgtacttgagatcgatcgggttgcggtccatcccgatcgcaaaggtccgtaacttcttgcccggcattaacttagatgcgatcgagcaaacgagggaagaatccagccccccggacaacaggtagccgaccggagcgtcagcgtggagccgtttttccacccccttgaccaggtaatcacggatgccggtcgtggcttctgcaaaacttggcgtgtgcatccgggtaaccatggccgggtcgcggtaggtaacgaacttttcgccgtcgtagtagtggcccggtgggaacgggaagatttggtcgcacaagtccatcagggtcttggccgtggaaccaaaggcgatttcgcccctctccttggtgtagccgtaaaacattggccggatcccgatcgggtcacgcccggccacgaccttcttggccaccttgtcgtataagacgaaggcgaactcggcgtcgagcatcttgcacatggtgtccaacccgtacttacggtagagcgggatcaaaacttcgcagtcactagagctttggaagctgaagccgtcttttaagttctccttgagctgtaagaagttgtagatttccccgttgcagaccagggtgcaatcttcgcccttgaagggttgcatcccgtcatcggacaggtccatgatcgacaggcggttaaaaccaaacatcaccgcgtcttcttcgacggtttcggtcatgtccgggccgcggtcaacgtttttctccagggcgtcgcaaaaggtcgttaaatcaaattccttagaatcaacagctaaaaatccgcacattgtaaagtctcctttgtggttaaaccgtggatgaaaaaaataagcctttcaccccttgcttttgacaagggacgaaaggcttatttccgcggtaccacccaagttggctagggtattactagcccacttttcattgagtacaaacatactcatccggtggtaacgttccggtcacgactaagcctactttgcaatgcatttgggttagtaatcttcgaaagtgttattcaatcgcagagggttggtcaggtttccactagccctgactcactggacaaatcaacgacctactcgtctttctcatttttctcttatttaatttttttccaattctagcgaactttatttaagttggcaagcccctaaagcgatttttttgaaaaaagtgtaacgccccgaccaaaaaaggggccaaaatggggtgaagaacgaacttcttaaattggggtgcagatccggttcggaagtgcaaaagctcacccaaagaagcttattaaccctttctaataaatcggctaataattgattctataataaagtatgggtaaagaaagcaagtagggaaggttaattcacccattgggggcgagaagtggacgaaaaacgcaccaatgtaattgaattatggtgattatttatacgctcaagcatcagtagacaatatataggtcgcaagtctgatataattttaggaaataaattaattcccgggtgagcaactcttggggtctggcgctgacgttcgcgtggcaatccgatcaataagattttaaccacttggctaaggaccgcagtgaggtcgtcaaggcggcgatcaaaaagtacctcagggaggtggccgaagatttcaaagcccacatgccaagcaaggaattgatcgtcgacaaccagcggctgacccgccacgaactgtccaagcagctgggcgtggaaatcgatttgatccgcaaccggacgccccgggatggccaagtcgaagtcgccaaagaacggctcgtcaaggagaagtgcccggttaaccaccgcgtcgaaattaacggcgaacggctgagcctgccggagttagctgagtgctaccacttgtcggttgaaacggtctacagccgctggaaacgaggaaagcggggcgttgaattgattaaaccagtacaaaaatagcgagattgggagtttaaaatgattgagattcacggaattgataccgatgaggcggggcggtgcacccattaccaccaggaagttgacgtggccgccctcaagtgcgcccggtgtcaaaaatactacgcctgttaccagtgccacgattaattggaagatcacccctttgccgcctgcggcaaggaagaactcgtcgtggtgtgcggggaatgcgggcagggcagcagatgaactttgcccagtacgctactggcacttgtttaaactgccagcaccccttcaatcccggttgtaagctgcattatgacatttacttcaagtaaggaaaacgttaccgaaccccacggttatgtttttattttgcccttaatttataacgaaacgcccctcaaaaagacagtagggcgcctttgtgtgcctaaaaaccgaacgatcgtcaggagtgattatgatggaatgatggggcggaaatggaggttaatggacgaatgcaccaagttggctccctggcgttgaaatgcgctaagttgatcctaaccagtgctaaagctgggctaatggtgattagtgagttctttttctgaattacgttaaagcgggacccgatcctaacgtttaatttacaaattgaggcaaaaaggatattaaaatcccgaacaataatgtttattaggtgattaattgatgagttgacctaattaatctattgatatatgatgtgataaatcaaattgataaaaaaccacgggtggcatcgaacgccgactttctcaattacggggaaaaggtgttttttaaaccagttcgttttatcgatggataatttatgcgggcgctcgtggcggatagacatctcaaggagaagattacgattatggttaggaaaaacaatcaaaacttacttgagcagaagatgggccaacgctacacccgttggtcgattcggcgccttagcatcggggtcgtttccgttgcggtcgcctcgggggtcttcttgttctcgagcgtggccttagggccaactgcccacgccactactaaccccgaagaagtcgggcgctcagctcgtcaaccagcgccaccagtggggaagccaatgccacgattgcggtggcttccgggcaaagccaagccgccgctgcttccagcgccgccgcgacgagtgacagcgccgttgctagccaggccagcgccaccagtgatgcagccagccaagctagcgcagcctcaaccgaagccagtgccgcaagtaacgccagctccactagtgacgcagctagcgccgccagtgccagttccgctagcgctatgcctgctcgccgggccgtccgtcggatgttagcaactgcgacgagtgagtacgaaaacgtgccgtcgactggggagacgacgattaccaaaagcgacccggggaacatgccggctggggtgtataagaatgtaccagccgatcaatacgtgtttgaagccttccggatgacgcaaggcatgtatacggggtatacgattacctttgcaactgatcgggcggggaaggggattctctatgtatatgaagaggatgccaaccaccatttggtaaacagttacacgctaggcaaggaccagtcagagttatcgcagagtttatacggggacttaacatactacaatggtgacgggacgatggttgttgattcgtacatgtcgaattcaatgtacgccaagccttcgatgaactacctgtggttctttgggcggccaactagttcccaataccttaacacctcaaagtactacaatttgacggatattgttccgaagttgttgacgcagaaggtatactacgttgacatcgacactggtcaacaattagcggctccgtttgaaacgcagtcactgacggggtaaacgtataagatttctaacaccaaagagtttgagcacttcaagttagttaagtcaccggcagaaataaatggttcagtttctcaatttgttaacgatggtacgactgtgtacccatataagggctacaattggcagggcatttcgtggcaatacatctttgaaaagttgaccacctacctataccaagacctagtaaacggcaccggggaagatccgctcttaaagaaaaaggtggacgcgaacaaactcggcttaaagaccgggcgtggctttttcgacttagaaggggacgccggtaagcagatcgtggctgaccgggataaggcccttttggaactgttgaaaaaagaccaggagcagtaatcagggttgcggcacccattgagcatactgaaatacaacaaggggctggaagaaaacggtgttcttccagccccttgtttcttatattcgctgtaactctttatctaaccggtaatccttttggggaccgtttacccaggtgtgttgggcgaagtgagcattgtccagttcaaaacgggcgtcgtaagtgtcgagggcacacaggtaggtgttgtccgggacgaggaggtgaccgttctcgtccaagcggtaggcctggtaaagttcatagttaccagacggttggtcgtgaaagtagaccagcacccggtcacccgcaaattggtagcggtattcccgccaaaaggagaggggcgccgccgttttacccatgatcatttcgccgttctccgtcaacaggaggctatcgggagagagcggagaaaaacgccaggtgccgtgcatggtggcggcggttcccgttgagttgtgggacgttccggtcaattgccagtcgccccaaaaataatcgtagagtttcaaaccgcgcctcctagcccgtggtgccttctaaaagggttaccggcagggtcacggattcgacgttggtttggccggcaatctgttgttctaacaggttaacggcgaccgccgccatttggtcgatcgactgttggacggtcgtcagttccgggaacaggatccgggtgccgtccgcgccgtcgaagccgaccaccttgaggtcctcggggacccggcggccacgggccttggccacttggatgatcagcccggcgttggtgtcgttgtcggcaaagatgccatcgacttcggggtgttcgtcaaagaggcgggcgaaaatggcctttttttcctccatcggggtgtcgtaattaaccttgtaggtaatggcggggtaaccggcctggctcatcagatcctcgtaggccttgcggcggtcctggttggtggtcatgacgtccttagggtaattggtgtggataatgtgttggcaaccggcgtctagcagccgctgggtcgccagctggccaccgcggtagttatccgaggcgacgaccggaatttgtggggcgaccgcgcgttcaatcgaaacgatcggtaagttggtctgcaagtaatccggcatcgcctggttgtgggcgccgacgatcaggccgtcaatctggtggtttaagagcaattgtaagtactgctcttctttttgcgggttgttttggctgttacccatcagggtccggtagccgttctcgtacaggcactcgtccaacccggcttcaagctggccaaagaaggggtcgttgacggtcgggaagaccaggccgaccaggttggtcttttgggtaaagagctggcgggcgattgcgttggggcagtaatggagctgttccattgcctcgtggacccgttgcttggtggcttcgctcaggtagccacggttgttgaggacccgggaaaccgttgttttggagaccccggccagggccgccacgtcttctaacttaacttgtctgcgtttttccaagatagcacctcgactgcactactaaaatgtctggccactgtaggggtggttgggtaaattggtgaagttaagcgtggcgaggtcggcaacggaagtggtgtagtgggtcagcgcttggccaagcattaggttcaaaggctcgtctagctcttgcacaatcacgatcggcttgttagagtgataagcgtagccaacttcaaaggcggttccggaatcgacgttggcgtggacaaaatcggccacggccaccactaggtcggcgtcgtcaatttcttcgacgtcctttttgaaaatcatctgcgcccattccggcgtgccttccttgagtaagggtgtgctattttcatccgacaggcggggggagaagaaactgtcgaccgtttggttttgggtgagggcttgttcggcccgggcgatgcggtcaatttgttcatcgctaaaaaaaggccctgctaagtaaatgcgcataagctgttctcctttaatggttaatataatttaatggttaatataatttaatggttaatataattattgtagcgaattgagcaaggcgacacaattgagattaagacaaaatatttgaaaggttgaattcaatcatgatacttttagtggttttcggtgggttaatttttgtgttggggtgcttttacctggttaattcctggcaacagtaccaccagtggaagtttgccaccctcttggtgctggtgagcttggcggtaacggtgtacggggttatcaacctgccttattggcataaaaacagcagcgcccagactagcagtcagaccagtgccaagagttcgtcgtcgggcaccagtagcaacagcatcagcggctattctaacaaccccgctttgtcctcttcgacggccaacatgacccaggaacaaaaagaagccgccgttttaaagcagctccaatcttcctattctaagttcggcagcgtggcctttgattcgggctccaagacctttcaaatcgacccgtctagcggcgacgaggccgactcgctcaagtacctggcccaaaacccaacccaagccagcagcatgggctggtcttctctgaccgattcgctggataagacgtcgacgcaagtgtccaagctcttgggcagcgactactcgatcagcttgatgaaccccaacgacaccagccaagtaatgtacacaaccaagaacgggatcaaaacttacgacattgctgaccaataatcgcttgcacgtctatgtaagtaatgatataattgcatagctgttacggagagttggcagagtggtaatgcaccggactcgaaatccggcgaacccatgttgaatgggcgcgcaggttcaaatcctgtactctcctttcatgtttaatttaactccgtcaagttatctaatataataaacttagtgataatgctaactttttgacgggaggtcttaaccatgaatcactgttgcgcactttgtcaccaccgctgcccccactcaaagtttcgctttggcttcctcattaagctagggtgcctttgtgattactgtgcccagcaggccttcgccgcttccgaaaaagacatccgctcctggatgaaagagcacaccctcgaagaatttttgatcctccaccaagtcaatggtgacggaatcccggtttattaccacccggtttacgcccactaaaagtacccttttaacgggcaatcattttaaacgacaaagagcctgagagaaaaccatgttttctcccaggctcttcctatatttccaaatgttagagcaaaaacgcgggaatcaccgcaagtctagtggctaagcaggccgaagaacggtgcggatcgcaccaaccgttcgtcctagcttagtcgtacgacccgtcaagaaggttcttccccgctcagttaacgcttcttttgaccaatgtgaatagcaccggccccgaagttgagtttagtgaccgtgacagaactcattcctgcttcttccatcatttgtttgagcttctcagccgaaacaaaggcccgggaagtctgctgaaggtaacggtagtctcggtagttgcccccaaagaccttggccatcagtgggaacagcttgaagtagcccttccaaccgacccggacgagcgggttattgggttgtgacatttccaaacagccaaagacgccacccggtttgagcacccgagtaacctcggccaatacctgattggcgtctggaacgttgcgaaggccaaagccgatcgtgaccacatcaaaggaattatcggcaaaggggaggtgcatggcgtcggcctgaaccagttcaatgtctttttggaggtccaggtcgcgcaccttcttttccgccaggtccaacatcgcttgattaaaatctaggccgattacgcgccccgtccgaccggcccgcttagctaattcgatcgtcagatctccggttccacagcacaggtcaagacaatcggccccaccagcaacgtcaagctgggtgaaaaagagcctgcgccaggcccgctgggttcccaagctgataacgttattcattaaatcatacttcccggccacccgggagaataattgattgacctcttcttcagggtgctgattagtgagtggcatagtaaatcctttccgtgtaaatcacatcatacgctaatgaggctgggaaaaatcttgtttttcccagcctcttactatctttgtttggttagttggctaacaccttacggtagtttttctttagggcagccacttgaacctgaaccacgttgttccggttcaggcgggcaaaggccagtgcatcattcaagaggttcgctatctctttggggtcgcccccttggtctagggcgttttgagtctctaacacctttagccgtggcaagaagtacgtaacgtgcttacgtgcgcagatgctaaccccttggtgaatcaagtggttactttccttgagcttaccaatcagggcttgatattcagctaggtagtaggtaatcgccagtacccgtaagtcatcttcgtggggaccagtatcttccatttggttcactagggtcttcaagtagttggtgaccttagtgaagaagaagctggcccgttccattgagtcgtgacgggtgtagtaaatccccaacccgaggtaagccaagtacgaataaatcgtttggtgtcgttcgtccagttcatcgagaatctgggtgaaggagaataggatctcgctactctcctggttagttaaaacgtagttaaagccctccaagtagaagtaacgcatcttttctttgttagccatgatctgatcaatcttaagcttgttaagccccgctgacacctgagggaagttctcgatcattaacccctcctccacttggtccaaagtatcgcggatgtagcgggcagaagaggcgtcttttctggtcaggtcatcgatcgttagccccagccggttacataaccgggttaagatcgctagcgacggtacctggctgtccttttcgaacttactcaaagtcgactgggtacagatacccttactaagggccacctgggaataaccaagctgtttacgccgtttgataaataattctacgtccatggtggccctcctttctagccgtgaatccccaaagcaatcttagcaaaccgactcatcttggacatgtcccaagccggctcccaaaccaggttaatgtcacattcagtaatcccgtccactgacttaacggccttgttaatttcgctgtttaacaggtcgccgagcgggcagcccatcgtcgtcagggtcatcgtaatcagacacttaccctcttcgtagacttgaacgtcataaattaaccctaggttgaccagatcaatcccgagttccgggtcaattacgttttctaaggcggccatcaccttgttttcgatcggtgaaaatggggcgccctcattttgatcagcagacatatgatccctccagattacttaacgatacgtgcatcaccgcgaatgaagtggtgccataatgcgaacagacaaattacaccggtcaagactaacaagccgatcccgagttcgtaagagcccgtccattccttgatccaaccgatgaccagtggtgggaagaaaccaccaaggccccccattgcaccaacgaagcccgttacggccccggtgttaccctgggaaacgtacggaaccatcttaaagacaaccccgttaccaaccccagcggcgagcccaactaggacaatcccggcgataaagagtggttgtgacttaaagcttaccataattaggattgcaaaggcaataatggccacaaagacccattgcaaaagcatcatcggccgcatcttgtcggccatgaaaccaccgaccggacgaataatggtgcagaccccggcaaagagggcggcgtaaaggccggccgtcacctgagagtaattaaacatcccggttaaaaagagcggcgttaggttagtaaaggccacgaagagcccgaaggtgaggaagtagaacaaggataggtaccaagtggaactttccttggccactgacagggcctcacccatcgtcttgttcgggttagttggcatttccttacagaagatggcgaagatcaccccgatcacaacggtcaggatcatcaaaaaattgtaaacggcggtaaagccgtgggacttggaaatgtacggcagggtcagggccgccacggcgttccccatgttccccatcgaaacgatccccagtgctagcccctgttgttccttggggaaccaaactgaggcgtaggaaacccccaaggcaaaggaagttccggccatcccgactaagagggccgcaaaaaggagcatcccaaaggagtgcacccgcggaatcatgaacagcgggattaagatgaagatcatcaagatgatgtaaaccttcttaccaccatacttatccgataagatccccaccggaatccgggcgatcgaccctaacagcaccggcgttgccaacagcaaggttctggaagccacactcaggtggaacatggtcccaacctgggcggctaagggggcaaagtttgaccaggacataaagcagacgatcatggccagggtggctaaaattaacgcagtataagcgttcagacggctcccgtgagccacgtcctgttgtgtagtttccattatcattatcctccaatttgactcatgtgacgccaagttggcgccttatcaatgatccgatcggtggtcttcatggccatctcgtggttgagcggcttgttatcaagtgcccgctgtacgccggccttgaaggcatcaaaatcgtagatcagtttacgaacgttgatctcttcattccagtagaggcatgccttaatgtagccatcggcggtgatccgcaagcggttacaattctcgcaaaatttggaagaaatagggtgaattaagccaaagcttcccgtataaccctcaacttggtagttgtccgatggtccgttgcccgctaagtcaatcgggtggtaatccagccccgcttgcttacacaggtcaaaaacactatccagggcaacgtattcttgcttccagtcctctaaggaattaccaattggcataaattcgataaagcggacgttgacatcgtggtccttagtgtagttaatgaagtcaagcagctcatcatcgttttggccgcgaattaagacaatgttaagcttaatctttttaaagtgtagtgccgaagcggtcgcaatcccgtctaaaacctggttaatgtttcctccccgggtaatttccttatagacctccggtttgaaggtatccaaggaaatgtttaaccggtcaagccccgcttcctttaaggccttggccttctttgctaagaataggccgttcgtggtgatggaaacgtcttcgatcccgtcaatttccttaatgcgccgcacgatgtcaaccacgtccgtccgtaagaggggttcgcccccggtaatccgcaccttatgaatacccaactgggcaaaattagtaattaactgaacgatttcatcctgggataaaacccggtcggtgggaaaaaaggggagcccctcttttggcatgcagtagacacaacgcaggttgcaacggtcggtaatggaaatccgcacgtagtcgtgcaaacgttcatattggtcatataaccttttcatggtctcctcctaaccgccactgaccggcggaatcaatgcaacttcacttgcttcactaagttgtaaaacatcctcgttgatgaattcttgatcaacggccacccggctattagccaaagtggcttctaaggctggatctagctctagtacggcatcttttaatgcggcttgcgtgactgatttaggtacatcaatctctaccgcaggaccaagacgctcccccaaaaaggcgaacagtttgacagttaccttcattattctccccacctcactttatcagtgtcgaattcttgcttccaaattgggacttcctgcttaagggtatcaattaggtattggcaccacttaaaggcgtcgccccggtgagcggctgccacaccgacaaagacggcttcttcggttaactgaagttcgccggttcggtgggcaatcaccacccgggcgccctgttgttcaattggttcagcaagtttttctaactgtcgctcagccattgggtggtaggctgagtaaacgatccgttccgtttcgatctctccggtccattggcgaatggtcccgacaaacatgtcgatgcccccgtatttagggtcaaccaatttagcgtagagttccgcaacgttaaggggttcgtctgaaatcctgagataatacattcgctatcaccttaccttatcagtttttattattacaatttgtttaagggtttagaattagtcaaatccctaataaaccgggcttgcagacgtttcccccgttactgttttcggtcctgtttaataattattccaattttagttagagattgggtgacccttgttgaccgtgtcagcggtcattgggctgccccacctgttacttacatgataaattcaatattccgattttgtctttaaggttattccctaataattgttttttttgctcaatgctatacttgatttaaatcaaaccagaagggggaatcgcccacgttatcaatcatctacgccaccatttccggtcataacttggaactagccgactacctacaagaacaggtagcttcgtggccgcttgcagtcatgaccgccgacgctgccgttgctgagctccccaccggtccactctttttttgccccgctacgtatggtgcgggtgaactaacggacgacggtgacctctttttaaccgacctcactagtagccctttaaacggtcaaccattttgggtcgtgggaattggtgatcaatgttacggcgatgactttggcgccgccatccttcacgccgaccaggttctaagggcggccggaggtaaccaactggctgcccccctgatcattgattatgaactcgatgaccttgccaaggacacacttaaaaagcccctcgcacaaataaaggagacccttcttgataaaccgtaagtcaacctatttaaccttaattgtggccctgttgctactcgtgccactcgccttaatcgccctgtcaatcgggcgaatgcaactaagccttggccaaacttgggcgggtttaatcgaccccaaacataacgccttatacgccaatattttgtatgatatccggcttccccgagttctcggggcgatggtgatcggggcggccctagccagctctgggatcgcctttcaaaacctcttcaataaccccttggtttcccccgacttattaggagtttccaacggggcagcggttggtgccgccctagcaatcctcttaaacagcaacctctgggtggtgcaagggtttgccctaattggtggaattctggccgtttcaatcaccgtcttaattccccgcttagttgaccaaggaggcaccctcattttggtcctctccgggatcattatctccgggtttatgcaagccgcccttggtctgttaaagtacttagccgatccagactcccaattgcaaagcattgtttactggcagttggggagcatcgctaaattagacattccgagcctgctggccgctttaccaatgatgatcattggttttatcatcctaattttcttccgttggcacctcaccatcatgtctttgggtggtcaaacggccgcctcgcagggaattaacattgaacgcgaacggttagtaatcatcttggcggccaccttgctgacggccggggcggtctgtttagccggaaccattggttggattggcctagtggttccccacattgcccggcgcctgattggggataacgctcgtttcgccctgccgcttgccgcgatcttcggtgccgccttcctgctagtcattgataccctagcccggaccatgtcgaccggggaaattccgctttcgatcctgaccggtttcattggcacccccgtcttcatctacatcctcgctcacagaaaggacctaattcaatgaccctcttaaacgtcaaccagctccactttgcctacggggaccgaacgattttcgatcaggtcagctttgacttagaaccggggcaaattatgaccattctcggtccaaatggggtcggtaagtcaactttgctctcctgcctaaccaaccaactcaaggaagcaaacgggcaaatcaacattaatgaccggccgctcgactcttggacccccaaggacctggctcaacacatggccctagttccccaggactaccgatcaggggcccacctaaccgtgattgattacttaaccaccgcccgggccccttacctcgggctcggtcaggttcctaacggtaaggatgaacaactcgccattgacgtcttagaagacctgggtattaaacagctgctccaccgccgcttacccaccctgtccggggggcagatgcaactagtggcgattgcccgggccctggttcaggaaccggaacttttgatcctcgatgaaccaatggcggcgttggacttaggacgccaacgccaagttttaaagattgttcaacaactcgcaaaaaggggcgttgcaataattttaacaactcacattcccaaccaagcactactcttaaatgaccaggtcggcctcctcttcccaggggggggattccttgctggacattgtcaggagataattagcagcgatcgtctagaaaaactctatcattgcccagttaaggtggtttatgtcccagaattgggacgatcaatttgtgaaatgtgctaataagtcagttttgcttaaaaagaccgacttttcctgatataattggtactagaaagcggttttccatttggaagaattggtgatcatgtgaaaatccccctatgtaaaacgggacttcacccaccgaccaccgttagtcgccaacgatggctaggccagtgatcgctcgccttccgatttgggtcaaccacgatcgtagactaaaccaactctttgaggggtgctgcaaaggacacccttaacgcacagagacgggaggaatcataatgaagaaagttgttgttttaggggccggctacgcaggtctgaaggtcgttcacgaattacaaaagcgcgccaacggacaggtagaaatcaccctcgttgataagaacaactaccactacgaagcaactgcacttcacgaagttgcagctgggaccttgccaccaagcaagatcagctacccggtagccgacatcatcaagccagccgtgaccaccttcatccaagatgaagtaaccggttttgacttggacgataagacggttagcttaaagaaccacgacgctttaagctacgactacttggtaattgccctgggctttgtttctgaaacctttggggtggaaggggccgaagaatacgccctgccgatggccaacctcgaacaagccgaagccatccacacccacatcttaaagatgatggatgaatacaagaagacccaggatccagactacctcaagctgattgtttgtggggccggctttaccgggattgaattggccggtgtcctcgccgacgggcgtaaggaatatgccgaccatgctggggttaacccatcccaaattaagatcgaagtggtggaagcttccacccgcttgttaccaatgttctccgagaagttggctaactacggggttaacgttgttaagggactcggggtggaactggtcactggcgcccggatccaaaaggtagaaccggacaagattacctacacgatgggtaaggacgaagaagaaaccactggtaccacgaccgggaagacgatcatctggacgactggggtttccggtagcccaatcgtccaagccgatgaagccttgaaggcgcggcgtggtcgttccattccaactgaccacttaaccgttgaaggacacgacgatgcttacatcatcggtgacgtcgccgccgtgatgccaccagaaggcggacgcccatacccaaccacggcccaaattgcgctgggaatgggtaagtacgtggctgaagacctcgctaaccggatcaagaacggcagccaactggccaaaccattcgtatacaagtccttagggacggttgcttccgttgggaacacccgggcctttggagaagcaatgggtcacgaataccgtggttacgtagcttctgccctcaagaagatgattgccaacgaatccctttaccgggtagggggcgctggtcaagtccttcgtaacgggcgttttgacctgtaccactagaaacaactttttaattaaccaaggggttaggagaaaaccgtgttttctcctaaccccttttatttatgaccattagctctaactaaagcaccagtatccaactacggttagtgaccgccgccctatctagtcaggcgggctgctggggcgcttatttaccactccctttggctcccagattagggattttccctaatatataaaaatggaatattagtgctagaatatagtcaactaacttgtggaggatggattcatggaaaaagaagcattaaccagtcaggttctcgacgccttagaggacgtcattgacccggaactggggatcgacatcgtcaacctcggcctgatctatgacgtcgacgttgatgacgcgggcaactgccagatcaacatgaccctgaccacccccggctgtcccctttccgacgtcttggaccgcgacattaaagaacacgccggtgccgtcgaaggggttaaccaggtcacggttaacctagtctggtacccagtttggacgatggataagatgtctcgctacgccaagattgccctggggatcggagggatctaaggatgaaagtaatcgattttaacctgcccatcaaacagctggccgatcagtacgatgattttgtcccgttgatggtcgaactgggctttaccaagatcaaaatccccggaatgctcgaatcggttggtcgcctggtgaacttaaataagggctgccgagcgatggggatcgacaaggacaaggtagtggcgacctttcgtgaccacggttttgaggtgatcaatcatgacaactagttccgtcgaacgccaaaaagcgatcgttgaaattctcaccttcctccatgagggtggtgactttgatcaagcaaaggaaatgtttgacgcccagtttgggagcgtcgacgtctccgaaattacttcggccgaacgccaactaattgctaacggccttaacccaatggagatccaaaacctttgtaacgtccacgccgccgttttcaaaggttcgatcaccaataacgccgagaccccggccttccaaaagcccggtcaccccgttaacaccctcaagctggaaaacaagatcttgacctctttaatcaacgacgagttactgccggtcgaaaagaagtggcaacaagacggtgacaacccggcctatttaaagcggatgcaacaagcgctcgccgaccttaaaacaattgataagcactacgcccgcaaggaaaatacgatctttcccctgatggataagtattgcatcaccgccccgccaaaggtcatgtggggagtcgatgataacatccgcggttggatcgaccacgcctaccagttggtgaccaccgagccgctaccggacaagtacgaaatcgaagcggcgattgaaaaggccgctaaagaggtcatggagatgatcttcaaggaagaagacatcatgttgccgatgctagacgaggtcgccaccccgaccgactggaagatggtcagagacgacgaagaagagattggctacaccctgatctctccaccgctaccgtggaaaccgaccgaagcggaactagaagaagcggccaacaagccggttaattcgacgattgctgccgaattgaacaaaatggccctgaacctggccgaccaagacgaccaggttgccgccgttaaggacgcccctactcaacacgaaaagttgtcccaaccagctagcagcgacgatgaccacttttttgaccttggtagcggtagcctcaacttaaagcagttggtggcgatctttaaaaccttgccggtcgacctcaccttcgttgaccacaccgatcacgtccgctggttttccgacaacgccaaccggatcttcccgcggaccaattccgtcctcggccgggcggtggtcaactgtcacccgccgaagagcgttgataaggtagaaaagatcctcgccgattttcactccggtaaggaggaccacgccgagttttggatcaacctgcacggcgagcgtttcatccacatcgaatattacgccttacacgatgatcaagggcaatacctcggttgcctagaggtcagccaagacctcaaccacgttcgttccttaaccggggaacgacgcctgtaattaattaccattgggagggatttactattaattctgtcactagccgccggcgaacctacttgggagtggagttgaacctgatttcactccttttttcttcgatttcaccgatcctcaataagttttcactggtcagcctcaacgccgtggtgggtggggtcttgacctccacctttgcggccaccttcaacctgattttgatcatggtgacctacaaaaaggtctcgatcgtaaaggacaaaatggttatcattttaggggccactaacgcgatcggggtcctcttacaatatattgccctgtcaatgctcagtccggtgacggtcaccctgatcgcccgcatttacctagtttacatcttcttattaggcggggtcttcttaaaggaacggatccggggctgggattacgtcgccatcgccgcctgcattgccggctcaatcttggtttcctctgggcgggcgcaatttgattcctggctcggtatcctctgcgcctttatctacccgttcatgtacgcggccaacaacgtgattgctaagtacctggttcaagatgaccacccagccgacgtcctctttttcaaccacttggtctcggccctgctcttgttggtggcgggctttttgatcccccacacctacactagcgtcccactaaccggggttgcctttaactttgggggcgcctttttcaacggtttcttgtcgctgttactcttttacactagccttaagtacatcacagccggtaaggcgaacattgtccgggccctggggccgctgatcgtgattgtgtattcctacttcttcttccccatcaccatcaacgcccagattatctgcggagcgctgctcttgattttggccaccacgatcgtgaccgtcaaacaagcccaggtaaatgaataaaccttactttccccgctgccttcttggtgacggggctttttgcatcaaaccaaagcgcggctaatgaaccatacccgaaaccaaatgatcccgcgttgggcagaaggatcagaaccaaagccgcaattggtgcgccgaccaaaagataaggcatccgacgaccaaatcgattccatgttaagtcagaatacttgccgactaatggttgaacgatcattcccatcagtggcggcaaaatgaagaagaagccaagcttggtcggatcagcaccgattgtttgaaagattcttcccatttgcgagctttgcagcgaaaatgccatgttaacgccgaagaacccaaaagtcatggcaaacagggtacttattggtagactcggcagtcccgtagttgttttttgattttccatattacttgttacctctttgaactgaattcatatactttagcttcatatggacgcagagtttctcccatgacatcctcgtagttgcttaataagagcttgccttgaccagccgcgtattctcgcttgattgtttccttagtaaagttggctactacaagcagcgttgtttctctatcatcacgcgtgtaagcaaagacctgctcatccaattcgttgccattgaccaacgcaaactttccttctgtcattactggcaagtcatggcgcatttgaatgagtttctggtagtgatagaagacggatgatggatccgccagtgccgcctttgcgttgatctctgaatagttgggattgaccgcgatccaaggttcagcatccgaaaatccggcattcttgctgtcatcccattgcattggcgttctggcattgtcccgagaatgaattgccagatatctgctcattgtctttccatcaactagatgctcttcgtcaaccagctgatggtaggcattaatgctctccaaatcacgatagtcagacaaagagttaaaggtcgtgttggtcattcccagttcctcacctgcgtagatataaggcgtgccttgcagacagtgcagcattgttgccaacattttagccgaaacgacacgatattttggatcatcattgccaaaacgggatacgacgcgtggctgatcatggttgttccagtaaagcgagttccaagccttaccattcagctgagtctgccatttcaccaggttatctcgcaattctggcagactgacttttttgtcgctccattttcctaaagctgggttgtcgttaccgtctaagccgacatgctcaaactcaaaaaccatgttcagctcagtctgttcaaggttggcgtacttcttggcatcatctgttgtagcaccaggtgtttcgccaactgttaccaaatcatgcttggccattacagcttgatgcatttcttgaaggaattcgtgcatccgatgaccattggcaacaaccggttcgacatcgccatactgcattccgggcgcggtcggaacgtctttgtagacagccggttttgaaattaagttgatgacatccattcgaaatccatcgacaccgagatctgcccaccaattcatgatgtcgtataccgaatgacgaacggcttcattttcccagtttagatccggctgctttacagcgaacaggtgaaggtagtattgaccgcttgtctcatcgtactgccaagctgaaccagagaagtatgatccccaattagttggttcatggccatcgactggatcacgccagatataatagtcacggtatggattttcttttccttggcggctttgcttaaaccattcattttcatctgatgagtgattgaccaccagatccatcattatttttaatccaagttcatgagcctttgtcagcagctccttaaagtcggtcaatgagccaaaagttggatcaattgcccgataatcactgatgtcatacccattatcaacgtttggcgaacggtagattggattgagccagataatatcagcacctagttttttaatatagtcaagccgactgatgattccttttaaatcaccaatgccatcatgattgctgtcttgaaaactccgtggatagacttggtagacaactgaattttgccaccaccattttggtgtatatgccattattatcattccttgtaaaaaaattaaaaataaaagttacgcaaacgtttgagtaaatgctaaaataataaaaacggcataagtaaccgttttcacggagtattataaatacagctaacttaaaaagtcaataactttttttgaaagaaggatcccgatggccacgattaaagacatagccagactagcaaaagtaactccatcaaccgtctctcgcgtattaaaccatagtgggggatacagcgaaaaaactcgccgtcgggttgagaaaattgcagatgagctacactatcaaaaaaacgaagctgccgttaatctggttgcacagacctcaaatctgattggagtaatcgtaaccaatgccacaacgagctttgccgcccccattatcgacagcattgaagattgggcctaccaaaatggcggaagaattctcttggctcactgtggcttaaatgactctgaacgactgaagacatgcctaaatctaatggctgggcgcaaagtcaacggtatcatttcagtttcggttcaatttgatgagaacaatctgaaactacttgatcaactgcagctgccattaatttctctaggcgtcaaagtttccaaccaaccaatgatttccatcgacaacctaaaagccgccactacagggaccaattatctaatcagccgcggataccaacggattgctctgattgccgtagataccagcgacccgcaaactggtagaacgcgttgcgcaggatatcaaaaagcaatggagtcagctggacttacaccatctattattcccggcgactactcgtttgcagcaggaaagcaggccgcagaacttcttttagcaaaaggagaacttcccgaggcaatttttgcagccagtgacgatgccgcagccggggttatctatgccgctcaggaacacggcattaaagtacctaagcaattggcagttctgggttttgacaactcatcagtagccagtatgatctatccgggaatcacaacgattgatcagccattcaagcagatgggacggttggcaattgaacacttgaccaaccagaatgtttcttcagttgagttgccatatcaaataaaggaacgtggctctgttgccaaatacaattcagctcagtcatagtgcagttctggcaatcaaaaacaggctcgtggaatctccacgggcctgcttgccgtattgttactctcaaaccctttatcatcatttccatctttacgaacactcattcgcacattgtaatagaatgcaaacagaagttcgaggagggcagcaagatggactgttcagaagagccgcggggaattttcctggtcattgataacaaatcattctatgccacggttgagtgcacgatgcgcgggctggatccgctcaccacgccgctcgtagtcatgtcagaagccgaaaataccaatggcgggctggtgctggcatcatctccaatggccaaaaagctttacggcatctccaacgtcaatcgtcagcgtgatctgccgcacgacaaccatttgattgtggtgccgccacggatgaatacgtacatcgaaaagaacattgaggtcaacaacatctatcgcgagttcatggccgatgaggacctgctgccgtattcgattgacgagtcgattctggacatcactcattcctggaaactgttcggggatgatccaattgcggtcgttaaaaagatccaaaagaccgttcatgaccgactgaagctggttaccacggtaggcgtgggcgaaaatccgctgcaggccaagattgcgttggacgtctatgccaagcatgatccacgcttcattggcgagattacctatgacacggtcaaaaaaaagatctggtccatccctaagatcactgatgcctggggcatcaacgagcgaaccgccaaacgtcttgccggactggggattcattccatggctgagctggctcatgccgacccgttcattctcaaggaaaagatgggcgttatcggcgcgcagctgtacgcctctgcctggagaatcgatcgcaccgacctcgctgaggaagtcctgccaaaagacaagagcatgggcaattcgcaggtcctaccgcacgattatacgagagccgaggagattgaagtcgtcattcgagaaatcggttcacaggtagcttctcggctccgcgcgcacgacaagcaggcagggggcgtgtacctttcaatcggctattcgctgagcacgccaacggaagaaaccggctttgcccactcgctgaagctttccgattcaacggtcgattcaaacctcatcaatgggcagctgctttatctgttctatacatactgggatggagtatcgccggttcgccgcatcagcgtggccgcgactcgcttggctgaccgctatggcgagcagctcgatctgttcaatccgcccaaatacgacatggttaagctggaagacaccgttgacgccatccgcaaacgctttggcaagacgtcaatcatgcgggcgtctagcttggagaagggtggcacgtttatcgaaagaagccagttggtaggaggtcatgccggtggacaaagcttggaataaagaaaccgaaagcgaaaaaatctgtgagcgaatcaagcgctgcttcaccaatcgctggcgcaccagatactgggtctccgtggtctactatgagccggagcatggctataatctgtttctcaacattcagccgcgcaacgcctacagccggtccatccccattgctcgactggctgattgtgattattctgagttgcttgatattataactgatgttcgtcaaacgtatcatttcacgctcaactacctaaactttcctgatgaccaggtccgcaaaatgaggaggaaccttcgatgagaatgcagttttacgatgatcaagaggctgacaaggtggccacgcagttttttaaatggtagattgcaagaaataaccgtttttccttgaatttgttgaaaaactatgtgattatggaagcgtattcaaatgccgtgaggaggctactatttatgaatagacaatttgatttcttaatgccaagtgttaacttctttggtcctggtgttatcgccaagattggtgaccgtgctaagatgcttaacatgcacaagccactggtcgttacccaagagagcttggaaaagatcgaaaacggccccgttgttcaaacgattgaatcactgaagaaggctggcgtggactacgccatcttcaccggtgttgaacctaacccaaagattcgtaacatcaaggctggtaagaagatgtacgaagaagagaagtgtgactccatcatcactgttggtgggggctctgctcacgactgtggtaagggaatcggtattatcctgactaacggtgatgacatcactaagttggccggaattgaaacgctggacaacccactgccacctctgatggctgttaacaccaccgccgggactggttcagaattgacccggcacgcggttatcacgaacgaagaagaccacctgaagttcgttgttgtttcctggcgtaacattccgttggtatccttcaacgacccaatgctgatgctcggtgtgccaaagtcagttactgctgctaccggttgtgacgcctttgttcaagcaatcgaaccatacgtttctgttgaccacaacccaatcacggacagtcaatgtaaggaagctatccaactgatccaagaagcattgccagaagctgttgccaatggtcaaaatgttgaagcacggaccaagatggttgaagctgaaatgctggccgggatggccttcaacaacgccaacctgggttacgttcatgccatggctcaccaactcggtggtcaatacgatgctccacacggtgtttgctgtgcattgctgctgaccacggttgaagagtacaacctgattgcttgcccagatcggttcgccgaactggcccggatcatgggttatgacaccaccggcctgaccaccatgcaagctgccgagaagtcaatcgacgggatgcgtgaaatgtgcaaggcagttggtattccatcatccatcaaggcaatcggtgctaagccagaagacttctcattgatggctgaaaatgccctgaaggatgggaacgcattctccaacccacgtaagggtacgaagcaagacatcattgacctttaccaaaaggcatacgatggtatttactaattaacggtgtgggcacatttaattagcaacgaaaaagtcacccgcaggtgaaaacctcatctgcggatgacttttttagtatttggtagattgtaaaatttaagttgaacatattagacagaaaaacccataaaggtctttaatggtgtcaccacaacattccattagaaagaaggacctttatgggcaccactattttatcatttgaagaccgcgttgtcatcgaacacttcatcatgaaaagcactcacttcaatatattgccgattatttaggctttagtaaaaccactatctttaatgaggttcatcgcttagctggtgagtatcacgcagttaaggctcaaactgaccatgaagttaaacttagtcatcgtggtcgtaaaaccatcttaacgactaacctaaagcgattgattgaagaaaaaatcaagatccaaaacaagatccaaaaatggtcaattgaacaagtggctcatgtagttagaattgcctacaaaatcatctataactggattgatcagggactactggatattaatgtgactgatttacctaaccatggtattcgtcggtattcgtcgcaaacgagctaaagaaacccgtggtagttttagtcatggacgttccatcgaagatcgtccagctgaaatttctaatcgtaatacttcaggtcacttcgaagctgatacagttttatctggaaaacgtaaaggtcaatcagtagctacgtttgtcgagcgtaagagtcggcttaccatcgttaaatggcttaatggacgagatagtacttcaatgtccaaggctattttagaattggctaaccagttaggagataatctcaagacccttactgttgaccatgggaaagaattcgccaactacaatttgattgaagaacagaccggtgttccgctgtactttgcgcacgcttattcgccacatgaacgaggcagtaatgaaaatcgcaaccgagtactacgccgcttcattcccaaaggtcaaccgattgatgagattaccgatgatgaattaattcaaattaactggtatttgaattgccgaccactcaaatgtttaaattggcgaacaccgattgagatctttttgcgtaatctgcgttaccaaatttgttcaagttatttcttgcaatctgccattagctaaaagtatttggctaacttgattataaaacgcgcgagtttaacgactttttggccatctgtccagaaatcgtgtcactttatctaacaggtgtcattgatcacaactcacatgaaacgtggcaaacgtcatcctggcacgggaatggtgaacttaaatcacattgaactttttgggtgcggcgcaaacttttttaacgaataaggttgactttaataattctcccagttattctgtgtgcatggttagaaaatgatgagattaattaaagaaaccaaggatgagctttagggaacggcttagcaagcgtggctgctgaaaacacgtgcgatcccttttgtaaaagttagtttcgagcatactgggcggtcgccactagtcgactattgagcaataaacgaaggtggtaccgcgcaaacgtgccctttagcaggaatgatttggagcgcgtttttctcattatttccaaagacagccaataaacgaagggaagtacatatgatgacaaaatatacagtaatcggcgcaggcgccatgggccttcgctatggggtcttgattcaagaacgcactggcaacccagtcgacttcatcgacacttgggaacccagcgtcaacacaatacaggaacaaaaaggcacttgggtatcgcgtgaccacaaagacaagcacatggtcccaatcaatatttccttcccagaagactacaccggcgatcctgacgtgtggatcattttcgtcaagcaaatgcaattggccgaggtcttgaagcgctgcgccccattgtttaaagcgcatcaatatgccttctctgcgatgaacgggatgggccacatcgataaaatctctgaatacttcccagatgaccatatcgttggcggcaccgccatgatcgccacagttttgaatggccctggcgatgtcgacttcatgggcgccccgcgcaccggcgtgatgcatatgtgcaacaagaccgaaaaaactgacgccatgacccaacaaatgtttgatgatttcaaagcagccggcttaggtccgattttaaccgagaacttcatggggactttgatgtctaaagtcgtcttcaacgccgtggtcaacaccttgtgcacgatgtttgaaatcaccatgggccagttcatcgagtaccctggcgccaaggacatggccgaacaattgatgaatgaatcgtttgatgcttgcgaacgcgcgggcatccacttggttgaaactcgccaagaagaagttgaatctgtcgattatgtttcgcgcgttgccaacccttaccattatccttccatgtatcaagatttctccaaaggccgcaacacggaagtcgactatatcaacggctatatcgctaaaatcggccgcgagcacgactacatctgccgcacccatgaattcttggttcatgaagttcatatggcggaaatgatgcgcaaatacaagcaagccaaatagctttgaatttcgaatccttctataatatcccgcaacgccttaccagctttgcgggttttttactggcttgagaatgcaaataggcgaccccataaaaatggcgcctcattgatgagacacctgaattattcgtttaacgttcttacgtattcacctgttgcacaaaatcaaactgattaccgtcaggatcttgaatgccgatcgtttgccagccccaaggatatgtcactggcgcactaggggccaagtttgcttcagtcagtcgcacatacaaagcatcgacatcaacctcggagaactcagttccccaaggcgacgtctgggcctagaataaaaagtgtacaagttaaatagagactctgatttagtatatttgtcgaagttagtagattagctgaataatttcagagcctgctctagcttttttgcttttgcggggtcttttttgtaatcggctacgtatttatctagtaggccgtttgcaatgttgttaatgctagtgccctcgaacttcgcaatcagtttcaagctgttagccgtggacggcttgagcaatagacttgcgtgctgagagcgtctctctgctgcatcaattgacggacggcctttaggggcctgttgtttatgaggctcagcagcattcacggagtccatgctttcaataagcgtgtctgcaggattggttaagttgctgaaattctttttagtcattgtttaatccccctaataactcggtaatgaaattgtttacgtccttggtagcttttgccttcggtgcatattcaaagaggttcatctgtttgccttgtgcttccttgatgacaatagcttcccttatcttggtattgaaaactctggtgtttagctgctgactggtgctattgagcatgttagtgattgcctgcgtgaacttggttcgtgcgttgtatctccctaataagatgcccagtacctgcagccgtggattagaccgtaagcggatggactgaattgtattggcaaggttgcccaaacctttaaggccgtaaatatctgcctgagtcggtacaatcacgtaatcagaggctgttaaggagtttagaacggccatactgattgccggcggtgtgtcgattactacatagtcatagttgcttaaaacgggctttagagcctctgagaggttgtactgtacatctagtaactgacgttttactagctgaatatccagcgatgcaagattaggactagccggtaaaaggtctagcttggccttgtgtttcatctttaccgggataatagcctcacccgctttgagttcgcccagaataacctcaagcaatgtctttctcgggtcgtactgtacaccggttgaaaaactagcatccgcttgactatccaggtcaatcagcagcacccggtatcccttgagcgctaatccgtagcttgtaaagagggacgtggacgttttacccgtgccacccttttgattagaccgtgattatctttgccattgttctacttccttagataatagttaatacatattatataacagatattagttaaatatggcatcatcaatcttttggctgctctgatttttaatggcattgaggttgtgagcatatatttcggttgtctgtaaattaacgtgctggagtaactgctgagtctcttgcaacgttgccccgttcagcaaactcaaggtagcggatgtatgccgggttgagtgtgctgttaatctagggctatcgtatccagccgcaataaagctgcttttcacgatgccgctaatacttcttgtagtcatccgctgaccggcgttctgatggcttgtagaggcaaatagagggctctgagggtcggatgccttacgtgcctttagataagtcctgacggccgtttcaacgtgattaggcatccttaccagagcatccttatctacgtgccctttaccttggacgtacagaacaacagcatctccctgcgtccgtatatcaccaacgttcgctcgggatacctcaatcgttctgagccccatcgtcagcattaaggcaagcatggcataatcccttttgcctttaagagtgtcctgcgggatggtttccagcactttcttggcttgctgactggtaagatagtccttcttatgctcgtggctgatttttgtttgctgataggggggactaggtcttttaagtcatcccatccagctccgtccttaatccggcggatgatttcttttgtatccatgtcagagctatgataccaagtcccatcgggcaacataagcatgtccaggtcttggttatattttattttgccaaaccgaaaaggagccgggaaaagtactgcttccccagcttcttattaatcttacaatgtcagcaaaaaggcaattaaggccggtaacagctgtattacccaaatcttctttgtcgcagtaaagccaccataaagggccaccaccatgataaagactagtagcatttgccacaccgtaatcaacagtacaccgtggacaagccaataactggcaatgatcattacccccagcgcaccattataaattccctggttagcaaacgatatccgcgcttccttttgccgcgtgaattcaactggtaggtcaaatgcccgtgcctgttgctctggactggcaaacatttcaatcagcataattccgatgtgcccgatggccactagcattaccacaaaaattactaacatttctattctcccttatttaacgtactggtttaggaaacgctccacatgctgtggatacccgtgtggctctttctcataagaggcggcatgcttagtaccctttaccacccataacttctttggtcccttcatcgtggcgtagttctggtaaaccatcttagtcggtacaaaggtatccttgctgccatggatgaaaagcatcggccggtggttgcgggccaacattgccgttgagctagcctcatgagtgtaaaagccattttttacccggttaattaaactcaacgagccaattaacggtgcgcgtattacccggggaatattatacaggtttcccgcctcatagttaagctcggcattaaggctgtcgtaaccgcaatcctcaacaaaggccttgacctggcgaggaaggtggattccactagtcatcatcgttgtggcaccacccatgctgactccgaagacaacgatttgactgtcctgaccattatgagcgattaacttcttactccacttccgtacgtcgtagcgctctggccagccatagccaatatactttccctgactttggccgatcaaccaagactttttcattatccaaaataaaaactcccctcgccaacgacgattctcaggactcgattactacatctaagcgttctaattaggtaaaaaattgccaaagctgttagtaagtttaccaaccaaaagccaataaacatcgctaccataatatgtttataaatgaaaaatcttggtaggataaatagaaatcctcctaaccaaggatagcaacttatgaccgcattcaaattatgtcctggtccaataaatgatatttcagctggtaccttaagatgacgtagcgattggaatacttgttcataacgtgccagatgtatttgtccatctgctggaattttaaatggggttaccccatttatcgctataagtacaactagaaatgatataaagatgtaagctatcgcctctaatatcctacctctagtttcttttttcattttttctatccctcataacctttatcattttcccgtttcctcaaatgataaatacttatcaagtaagttaccaccgtcttaacaactgcatagcacggaatacaaaggatcatccctggaatcccagcgatattccccgcagctaataagagcattatgatcgttaatgggtggatctgcagggttttgccaatgatattcgggtagataatgttaccgtcaatttgctgaacgatcacaaccaccacgatcacccaaataatcttttctggggctactgcaatcgaaaccattaaagacggtgtgatcccgatataaggtcccacatacggaatcatgttggcaatccctgctaccacgccgagtgctacggctaagggctgaccgatgatcaaatagccaatcgaagttgcaatcgccacgaacaggcactcaatggcttgcccagaaatgtaggatgagagtgtttgactcattttccttaatagctccccaacttcatcccggctattttccggaaagagtttttgtacgctcggtaccagtcggttaccatccttaaacatgtaaaaaagcattacgggaacggtaatggccacaatgaccgtactcgtaatcgtcccaatgattgttcccgcacttgaggttaaaccagtgacaatctggcgaacgtacttagaaacttgatcattaatttgaccatagtaagtagataagtggagttttcgtacccacgggtgttccgagatctcttgaattatcttctggctctccttggcagcctgggggagccaatgtattacttggtttaactcattaagcaccggtggaattaacgccgaaatcccaccagccacaatcaagacgagcccgatcaccaccaccaagctcgcaatcccccgcttcatgtgccatttgtaaatcttgatcttcattaataagcgaaagagtgggtttaacatgtaatacaaaaagagcgagatgatcagcggggtgattaccacggaaacgaagaccagcaaaggggtaaagacaaagttaatctgggtgcagacccagattagactcgcaataatcagtaattcaaacgaccaaaagagcgctttttgataactttttggcattatttcttttccttaatgatgtaaatcggtctgttcttaacttgcatgtagatacgaccgatgtatttcccgacaatcccaatgcagagcagctgtagtccccctagtaaaagaatgatgcaaaccatcgaggcccagccaaaggcactactcgttggttctatcagtcgacggatcaccacaaaaatcaacccaatgattgaaataataaaggaggtcgttcctagccaaactgctaatgataatggtgcctgcgagaagtcggcaattccgtccattgcatacttaaatagtttccaagttgaccaatcagtggttccggccacccgctcaacgtttttatactctaaatacttagttttaaaaccgacccaggagaaaattcccttggaaaaacggctgtattcattcattgaaagaatggcatcgaccatttggcgggtcatcatccgaaagtcacgagcccctggaacgatattggtttgcgatacacggttaataactttataaaattggtcactgaggaaggattttatcttggcttctcccttccggtcggtccgccgggtccctacacaatcgtattcaccttcctggaggatggaatacatttggggaagaaaggacggcggatcttgcaagtccgcatccattaccaccacgtaatcaccggtagctgcttccagaccagcatagagggcactctccttcccaaagttccgggaaaaggttaggtaatgtacccgttcaggatcaatcgaatgcaactttcgcatttccgctaacgtttggtctgcagaaccatcatctactaaccaatattccgtttttaaaccatctattctttggaccacctcttctacagctgggtaaaagagcgggagggcttcctgttcgttataacagggaacgacaattgataactttggcatttttaatcctcttaaatttaaataatgaaaaaccggtaccgcttagcagcaccggttttcattatacactatctaacaatgaactttgactagttctcagtaatggaagttggtgaaacattgtaagtgtaagtcttaccgtttaccgttccagtaaattgccagctgttcgttcccgtttgcgtagcggtaaaggaatcaacatcggtagctgatggttgaactggcattgattgacctgacgtcccagcattgttcaagttagctccgagacgttcctttaaaagatccaaggcttgggtctgagttaaagtagccgttgaggcacttgatgaagagctacttccgttagaagagctagaattcgaggcggttgcggctgccgctccccgggaagcacttgacgaagacgttgatgagttagcagcggttgctgaactggaagatttactagatgaagaactggaatcatcagaaaccgtctttacttgttgcttcttcgtcgtggagctcttctttgaggccgccttactacttgcgcttacgctgtccgtagtatcactcccactcgcagatttattactgctgcaggccgctaatgaaagaagcatcgccccagcaacaattgaagttaatagcttgttagctttcataattttttcctctcaatatctcgaactctgattcttaatcacattataacaaagtctttgttcgatgattagtcataacttcacaattccctaatattttgaaaaagccccaggatatccctaaggctcctccttatatcaactagcttaagacgatgtagtagctaggcgtgaagtacttttggtaaccaatcttgacgttttcaccgaccgttggggcgtgaacgtaagaaccgtcacctaatgagatggccacgtggtacggagcggaatcactaccgaagaacagcaaggcaccctttggagcactagaaacgttggagtaaacgtgcgtcccaagcgtttgttgttggtaagtcgtccggtaactagaactcaggccgtaagcccattgaactaacccagagcagtcaaacccaacggaaggagagttaccaccccaaacgtatggtactccgatttcgcctaaggccttgttgactttggcatccatactatttacgactgtagctgctccacttgcattaattttatactgaacgccatttacagtaatggtagtgttagtaaccattaaatgagaagacggatcaaagtagtatgtggtaccttgccatttaacaaggcccgacatcagagcaccatttgagcctaccatgtaataatttccccattgggatttaacataatcttggtggtctaacagaaggttagtagatggatcaaagtagtagtacgtccccatccacttttgaactccggataacaccttcccatcgctacctgaaaggtaacccaccttttggccattcggaactgagtatgtgttcttagctaataagtaactggattgatcaaagtagtacttcgatccctgccaacttaccaatcctgtcatcagggcaccatttgagcctaccatgtagtagtctccccattgagacttaacatagtcttggtgatctaacaataagtacgtagatggatcaaagtagtagtatgtccccatccacttttgaactccacttagtacgttaccgttagaattaaccagataacctaccttttggccattttcaacacgatacgtgttttcctttaatagttggtatgttgatggatcaaagtaccactcactaccgtaccactcttgcgctcctttttgagctaccccatcttgaagaagataccagcccatggcacccttagtcgtatcagttaatgacggtaactgaacatactcacgaccagtatccgttgttccattggtattgtagtacaccttctgaccactagcgttagtaacccaaccagacttctttccagaagttgccacactagcaacttctcggaccgcactagcagaatctgcttcctgtgaaatggttgctgaagatgaaacagtattgcttaccgacgaaactgcttgtacagatgtcgaagtagatgctgcgctaccacttgataccactgccgaactagccgcctcaacagtagctaccgcactgacttctacattctcagcactaacgacgctagtactattcaatgctgatgaagcagtttcattatctgcactaacttggctggccacagaagcactattagtaacattagctgaggtagcactcgctacatcggttacagagctttcactagctgtcgccaacatcacttgttggctactgcttgatgttgactgtgcgctagcacctgccactactgggttttcgcttacgctatcagcttgtgcatttgcagttgttgctgttgcaacacctaatacggttgcagccgtggtaattgccattacacaccactttttaccgtctttatacattttgaagtgtttatgtgcttccataagctctagaacaatcctttcaacagtcattaaattttcaagctttgtttttaaatttatacatttttaaagataccacaaaattgactgttatctaccttttcaaggaatctgttatccaataataactttcgaaatcttcatgtaacatttaaaaacatacttaaccttttcggttattgtcctaaaaaacctcttaactcgaagctatcttcgagttaagaggtctcgtgatttattttaactcacagtaacaatacgttattacagtccaatttagtactaaaatttattaagctctcaaccaattatttggcctataaacgtggaatgatggactttcagcatagttatagtaataattgtagtttagttcttgaacagccgtcccctcttcaccttcagtatagtaacaaacggacaaagctgttgctccactaccactaccatctgcaatgattaaaatatgaccatccccaccagtagcgtcatcccagataacaatatcaccatactgtggactgttaacgataaccatacaacaaaaagaacgaatttgaaatattctcttttcaacattactttatgaattgaacgctttgtaatcccacgaggttaaaccatttgcagtaatcacactgtttagtgatgaagcataatttggatctgtagcatagccatcttcatgcaaaagatatgttaccgtcgaatagttacgattccataataaattgctataacgactattagatgctaagaagtaaccatgatcttctatgctttgataatagctagggtattttcggaactggtcgtagatatagtaataaccagaactcccatattctgctgttaacatcgttacagattgtccgttataacttcctttgataccaaataaattatatgcttctgttgctaatgttgactttccccagccactttctaaaatcgcctgggctgctgtaaccgatgggagaacgccatattttttccacccatcaatcgcagcttgcttaatgatcataaggaaagcttgattccccgtaagaagtgttaatttcccatcactagccacactatatgcgctgtttccagatacaacactcccacttgtctttaataggtatgatgatggatcgaagtaatacaaagaaccttgccaacttactaccccggtcattagtgcaccatttgagcctaccatgtaatagtatccccattgggacttaacataatcttggtggtctaatagaaggttagtagacggatcaaagtagtagtacgtccccatccacttttgaactccggataaaaccttcccatcgctacctgaaaggtaacccaccttttggccattcggaactgagtatgtgttcttagctaataagtaactggattgatcaaagtagtacttcgatccctgccaacttaccaatcctgtcatcagggcaccatttgagcctaccatgtagtagtctccccattgagacttaacatagtcttggtgatctaacaataagtacgtagatggatcaaagtagtagtatgtccccatccacttttgaactccacttagtacgttaccgttagaattaaccagataacctaccttttggccattttcaacacgatacgtgttttcctttaatagttggtatgttgatggatcaaagtaccactcactaccgtaccactcttgcgctcctttttgagctaccccatcttgaagaagataccagcccatggcacccttagtcgtatcagttaatgacggtaactgaacatactcacgaccagtatccgttgttccattggtattgtagtacaccttctgaccactagcgttagtaacccaaccagacttctttccagaagttgccacactagcaacttctcggaccgcactagcagaatctgcttcctgtgaaatggttgctgaagatgaaacagtattgcttaccgacgaaactgcttgtacagatgtcgaagtagatgctacgctaccacttgataccactgccgaactagccgcctcaacagtagctaccgcactgacttctacattctcagcactaacgacgctagtactattcaatgctgatgaagcagtttcattatctgcactaacttggcttgccacagaagcactattagtaacattagctgatgtagcactatcggttgcagagctttcactagctgtcgctaacatcacttgttggctactgcttgatgttgactgtgcgctagcacttgccactactgggttttcgcttacgctatcagcttgtgcatttgcagttgttgctgttgcaacacctaatacggtcgcagccgtggtaattgctacaacacaccatttctttccacttttatataacttaaatcgttttcgaacttccattaaaatttaatcctcatagatcatattcaaaataaaaacctttacctaccgtagtataacaccaaggtatgcaaaggtaagaaattcacgtgatttgtaagttaacagtaagtattgaaacattgtagtaacattaaggaagtataactctgatcggtttgattttttttaacataataataagtgacacaccaagtatatatacaactacgggcataccaatgatatataattgtctcatccaattaacatgcatgattgaaatataccaagaataaaatattggatgtaggatatataatcctaaacttccaccagagaataatgaaaatactttttgtaacttacgattcgatatattttcgcaacttttctttatgataagatataacgaaattgagtatagaaacgggcttaaccctgtaaaaataatgtatcgatcaaatgtccatgctgatataacacttccaaagcaagtaatcccacctaaaataattagaatatattcaatccttttatctagtaattcttccttaatcagatatcccatcaaaaaatactctgcatcagctacatattgaaaccatccaagaaatattgaaaaactaggaactgataatcctgccaaatttaaaaagtatggtaataaatcgttaataaaaaagaggactcctactatgattatcattatttttttggataataatgacagaacaggagttgcaacatacaaaccgacaattacataaaagaaccagaatgtattattaatatgatttgaaaaaaaagcttgtaaaaaatgacttactgatggatcactttgagggatcggtccaggatatgccttccattttaaatcatataaataatacagcacagaccaaactaaaaatggtaccaaaactcttagaattcgatgtttaaagaactcaactgtactgtatctttctctataatttaagattgttgcacctgaattcataaaaaataagtataccgccggaatacatagagactgtattatccgcgtttcctttactaccggtatattcgctgtagtcgcatgtgctaattgcgaagaatgtagcatcaaaacaaaaaagattgccatacaattaatcacatctacgtacactaatcttcttctcattatacagtcccttctaaactcacataattaatctactagctgtttcaatcgcttgtagtaattatcgtcataaaacttacacatagtattctgtacctctgtagagtaaaagtctgtttttcgtactctttcaagtgtttgtgtaaaatcgtctaagtctcccagatgatagaccaaaccattcttgcttggaattatcacatcttcataaccactaaaatcagcagtaaaacacggaattccatgtgccattgcttcaatcatcaccattggaagtccttcatactttgatgttaatactaaagcattagggtgaacctcttctaaaacctctttccacaaatttgttgtccaaccatggaaagtacattgatctaaaacgccaatttctttagcgtatttttctaccagattatcgtctttttttgccccaaatagatctaaatgtacaccattaccataacgcttaatcccatctagtaactcttgaaggtttttttggccatggagcataatttgcccaacataaaccaaccgtactactttatctcccaatggatgatttaatggtccagtatacggggtaactgggtttaataacaggtggatactccccttttcaatacctagatccgccaattgattcgcaataggagtactgatagcccagtgttcatcggcataagtaatattctggggattaaatatatcttgattaattaaagagtagtgaatccaagatattaaccgccaatgacggcgacgaatttgtcttatcttcgcagcaagtttaataacattagcccctaacataacgattgtttcgtcatttgaagcctgccacagaactttcagtaataaagatagtttactaagtttacttgatgacgtaacttgtaagatttcaacattgggatctaacacgtctaaccaaagccgattagcaggaatacttgttaccactaatttgacttggtgtctttttactaggtggttcagtgctttatcaataacggtttctgttccaccgtttccagatagctcaggacaaacaaaagtaagtttcattacttttctccttttcctagtattccctttgcttggtcaataattggtgctcggaagatgattaaacaaactacatataccactattccaactataacttgaaatgctaggttgacaatgttcatagccattatttgatcaagtcgaagaaccaccacatacattattagcccacttaaaaggtatcgccaaagcccagtaaaaagcatccgccgccgaattgttgtccgaacacaatataattgtacggctgtgacacaaagctcagagattaccgttgctatggcagctccattagctgaatacgttggaattaggaaaaagttagcaatgatgttcaccaccgccccaacagagactgaggcagtaaattccttaacccgattaactggcatcaggtactgtgttcccgtaacgttactccacgcaataaaaaggatcactggtgcttcaaaaaagatgatccctccagcttcgttatacccctttcctaaaaaccacggggcaaattttgccgaaattgccattaacccaaacatcattgggactgacattgacgtgacgaagtcaaaggatttatagaggctttcacgaacccctttatagtcaccgctggcaaatttattggcaacgtgagggagcataaccgttcctgttgcagtcacaattgccaaaactaacttaacaatcttatccgagaaatcaaactgccctagcgccgttggttgaccaatcttccctaacatcagcttattaacaactaagtatatttgcgttgtaatggttgggataaaaagtaatagcgatgggtaaaaatgctgaaaagggtgccactcttttggtgaaacccattgaatgctttcttttaggtacggccaaagagtaatgttaccccctacctgcgaaatacctaataagaagatatactttcctaaatcgcctttattctttaccaacgtgaagattagaacgatcgatacaattttaacaattgtatttcgaacaactgtctttttgaagtcctccatccccatgaagtaccatgagacatctaacccggttgcaacaatccaaagggtctggattaaataataggttttaaaggtagttgaaaaaagaaataccgccattaaataggctactaaggcaaaggtaatggtgcataattgcaacgcttcaattccccaaaaagttcgggagcggtgatacttatcgtcacgatgataagcaacttctcggttcccgtatagagtaattcccatttgccccattaaataaaagaaagtgacccaaccattcgtataagtgttgatcccattttcatgtgcaccaagaacccgtgaaatatacggggtcgtaattaacggtgcaaacatcagaagaacctggtaccccgcattatacagatagtttttaatcactctcatgcttacttattaaactccttttctacgcatacaagggccgcgtgaagaacttggtccatgtcatagtagcggtattggcccaaccggccgccaaagattacattggcttccttttcctgggcaagcttagcatattgcttgtacaagtcattgttttgctggttgttgactgggtagtatggttcatcaccgcggtgccagtcagctgggtattcccgggtcacgatcgtcttgtccttgtcacccttaccaaactcaaagtgcttgtgttcaatcacccgggtgtacggcgtttccgcatcagtgtaattgataacggcgttcccttggtagttatcaacatccagttcttcggtttcaaaccgcaggctccggtattgaagttcgcccaattggtaatcaaagaattcatcgatcatcccggtgaaaacgaccttcgggtaattagccaggtattcttcgcgcttagcaaagaagtccacgcccgtttccacatcaatcaaatcggagtccagcatcttttcgacgatttgcgtgtaaccaccaattggaatcccttggaagtcatcgttgaagtagttgttgtcgtaagtcaaacgaactggcaggcggcgaataatgaaggccggtaattcggtcgccttttggccccattgcttttccgtgtagcccttcaccagcttttcgtagatgtcacggccgatcaatgagatcgcttgttcttccaggttttgcggcgtcttgccggccatttcctggcgttgttcattgatcttgtccattgcctcttgcggcgtccgaacgccccacatcttgttgaaggtgttcatgttgaacggaaggttgtacatcgttcccttgtagttggctaccgggctgttagtgtaacggttaaaggttgcgaactggttaacgtaatcccagatttccttattggaagtgtggaaaatgtgggccccgtattggtgcacttggatcccatcaacttctttggtgtagatgtttccggcgatgtgatcacgcttttcaatcactttcacccgcttgccacgtttagcagcttcgtaagcaaaggtggcaccgaataaaccggcacccacaactaagtaatcataatttcccatagttacttccttccgtttaatacaattagtctaaaatatcatatctcaattcaatgaaaacaacaactaccgctaataataaaaggaacggggttttttgcgtatcagttgtagttgcacaacctgcaatgaccactaggaatttttgtcgtataataattatttgaggtatatattatgaatgatgaaaagctttacgggtatttggttgttacaaatgtctgtaaaaagcagatttacgaatacaagagactttttgctaagtcaataaatttaaatcaggttgataaaaaaagatggaaattatcttttagaaaatacaatcaacaattgtatagactttcattttattttgacaactctcttgaaggctattggtatgttcttcctgcaaagcatcctaaattgaacattgatatactcgctaatataaatgaagaatcagaaaaacttctaaaagaagagtggttttatggtgtaaaagataaagaaggattgtcttcactgctgggacaggttgataatagtttttttggtattactccatatccaacaattttatataaagcaacatatttttggtatacaatatcaacgaaacagatgtttaataatggtaataaaagaacggcactattaacagcgttactttacttaaaagtaaatggttattcatttgatatacttgatgaagtagctttatataatgtgtctataaaaatagcgaatagagaaatgccatttaaacaactttaccaatatatattaagacattcttatattgattttggcttttcaagaaacatactttcagataaaaaatcttgatacttactaatatatatagtagtatactaatatcgatttgaaaggagctggtataatgaatcaaaagttaagaggacaattcgttaaagttccaagtaaaaaaataagcaaggttgtaaataaaactgttgatattaatcctaaatcaactatgaatgaattattagaaaaccctaaattagtaaagaccttacaaaagttatcattagtttaaaataaaaaaatccagcgatgattaaaatgacaaaacaacccccgattccatttgaggatcgggggttttctttttgctttctttttaaaatgcccagaaacgttgatgtggcgggcttcttttatttttgctttcttgcacatccctttgcaactagaccaattttaaacaaaacatcatcccgaagcgccgtgtgcaccaaatgtgcaccaacttcaaaattttatggggcttttcaggtttttctatgtcgttaaaaccgctacaaataaggatttgtggttctctaggcttcttcaaaattcttcaaaaatgagacgggtgggaatcgaacccacaacctttggtttagaagaccaatgctctatccggttgagctaccgtcccggaccatcttagtataaagagcggaccggaacttgtcaatcacgatcagaaaccaccataataatagtcaagtatttcaagtaagcgtttgacgacggtttgtaatgaacatataataggaagtaagggatagagaaggtacgttttatatcaaagacaccagctagtgtcaaggttcttgaatgggggttcggtaagatgacagtcattaaacaagatccacgggttgttaagacccaaacaaacttacgccgggcattagtttacctgatgcaacacgaaaagctggaaaatatttccgtccaaaaaatcacgaagaccgccaatatcacacgggggaccttttatctccactaccgggataagcaggactttgtcgaagcggcgatgaatgggattatcgaccagctctttgaacacgtcttggagaaggggaccccccgtgaagtcactgacggtaagattttgcagaccatgagcgttagcgagaccttttcttatatcgagaaaaatgccgatgtctttacggtcttgttgagtggccaacaaaaccgttacttctaccaacagttgtataaccggctaaccgaagtaattaccaattacgccaaggggctcgggaccgacctagaggaaattgacgttcccctgcggatccaggtcgcctttattacctcggcgctgttggggttgatcatccgctggttggatggggggttaatctacacaccacgttacatgaccagcagcttggagaagatgctcaacaactttgctagcagtcacctgttgattatctccttcttggattttcaaacccataacggcttagaaatttaaataaaattgggaccgccttttcgttattgagttgacgaaggggcggttctttggtaaaatcaaaacgttgtatttgtgaccccacaactacaaccgcacgatggcgagtttaaaagcattcgctactcgtcttggcgagtcttaatttaaggaggtgcacagaatgtacgcaattatcgtaactggtggcaagcaatacaaggtagaagcaggtcaagcaatctacgttgaaaagctcaatgctcaagcaggtgacaaggttacctttgacaaggttgtcttcgtaggcggtgacgacactaagatcggcacgccatttgttgacggcgcttctgttgaagggactgttgacaagcaaggcaaggaaaagaaggtcgtaaccttcaagtacaagccaaagaagcacacccacactaagcaaggtcaccgtcaaccgtacacgaaggtaacgatcgacgcgatcaacgcttaatgaggtgttaaaatgattcgagtctcatttacggtgacgccggatcagaaaattacatcgtttaagatgaccgggcacgctgaatctggtcctgatgggcaagatattgtgtgtgccgcggtctcggctctgacaattaccactgtaaatggtttggaacgggtgctgaaaaaagaagccaccgttacccaggatgtggccaatggggggtacctcgaggttacctacattgatcagggtcacgatgctcaattaattctccgagtctttgcgagtggccttatggatcttcaagagcgctacggagaattccttgaggttaaaatgttttattaatcttttgctggaggtgaacaactatgattatggatcttcaattcttctcccaccacaaggggggcggttccactgccaacggtcgtaactccgccggtcggcgtcttggtactaaggctgctgatggttccgtagttactgccggttcaattctttaccgtcaacgcggtacccacatcaacccaggtgaaaacgttggtcgcggtaacgacgacaccttgtttgcactggttgacggcgttgttaagttcgaacgccttggccgggacaagcgtaaggtttccgtttacccagtggctgaataagctcataatagaccgtaagcaatttgcttgcggtttttttatgtttttaaacaaaattagttatagcgctcaggaagggaccaatatgaagacaagaattgaacgactccgggccggcttcgaaaagcaatacattgatgcgtttttggtgaccgataaaacgaacctccgctacctaactggctttgacctagaacagggggacggggggctgttagttaccaacaccgacgccgtgattatcacggatagccgctaccaagaagccttacgggagtttaaatcagatgaagtggtcgcaacgatcacccaggattactggggggatctaaataagatttgtaagggaatgaaggtgtcggtgctcggctttgaagacacccttagttaccggacctttgaacggttggacgacctgatggaagccgccatcgtgccctttgaccgggtggtggaaaagatgcgccgggtcaaggacgctggcgaggttgaaaaactgcgtaaggctacgcaactccacgaccggggttacaactacctcttgtcgattgcccacccgggaatgagtgaacgagagctagccctggagctagactactggatgaaaaaaaacggggccagccgggcttcgtttccaaccatcttagccagtggcccgaattcggctaagccgcacgctaccgtttcggcccaccacttaaaggaaggggacttggtgaccctagactttggctacttcgtagatggctacacggccgatatgacccggaccttcgccgtgggtcagcttgaccaacgcctggttgagctccaccacctgatcgacgccgcccaaaagaacgtcattagccaacttaaggtggggatgacgggtaacgaagcggatatgttagggcgcaaacccttagaagacgccgggtatggcgactacttcaaccacgggatgggtcacgggattggaatggcggtccacgagtttccggattcctttggcccggccactaaccgctataagttccgtaacaacgaggtggtgactgtcgaaccgggggtttacctgccgggagttggcgggattcggattgaaaatgatgttttggtgacccacatgggcgcggaagtgttaactaaggcccccaccggcctgtttgtgattgggtgagaatttgcaatttgcccatgaatagtgcaaaatgtaaaagataacgcatgcgtggcgtgcccgatttaatgtagataggaggccaaaccgatggctgaagattcaacgattattttaaatagtgacgaccagtccttgggcaagatccaaattgccccccgggttatcgaaatcattgccgggattgcggccaatgagattgatggggtttctaagatgcacggttccttagcaaacaacgttggggaactgctgggtcgctccgaccggcgccggggggttaagttgttcaacaaggacgaccaaaccctggccattgacgtcgacgtttacctcgattatggtgcccaactaccgaaagtggcggctgaaatccaggataaggttacccaacaagtggccctgatgaccgacttgacggtgagcgaagtcaacgttcacgttcaaggggtggtaacgccaaaagaagaacaggttgtcgaccctgataatttattcggacaagaagaaagtgaagatggtgaagattagtgacttttaaacgacgcaaaatccgggaagtggccttccagaccttgtttgccatggcctcggacccagaggttgaccgggagcaattatacaaggagctccttcccctcgctcctcaagaagaggtgccggcctacttggaagagctggtaactggggttagtgaacaccaagccgagtttgaccaagagattgaaggctcactagcggcgggttggagccttttgcgggtggaaaagccgaacttaatcatcctacgcttggccctttacgaaatgaagtacgttgatgacgtcccagtggccgtggccattgatgaagccctggaaatgacgaagaaatttagcgatgataaatcgcgtaagtttatcaacggggtgttgggccacattggggggccgaaaaccactagtaactagggagaggggagccaagcgattagcaaggcgcccttttcttattttcaagcactggtcgggcgtgttaaaatcagtccatggtaaaaacggaactttggtgggagttggttgttaatctcacatcataatccgaacattaaccagaaagtaaccacagtgagggaggaaccatttaccatggtagaattaattgacggcaagcaattagccaagcagctaaacgaagaaactgcgactcgggtagcggcgttaaaaaagcgggggatcaccccgggaatcgccgtgatcttagtcggtgatgacccggctagcgccatctacacccgcaacaagcaccgcaaggccgaaaagctcgggatgaagtcggtgttaaagaccttcccggccgatgccagccaagaagaggttatggcctgtgtacaggagttaaacaacgacccgagtattcacgccatcttggtccaatcgcccttaccgaagcacttcgatgaaaaagcgctcgacaacgcgattattccggaaaaggacgtggatggtttccacccttataacgttggccggctctataatgacgatcccgacaagcgatacccggtctcttgtacgccacgtggggtgttaaagatgcttgatcactataacgttgacctggatggcaaggacgtggtggtaatgggacgttcgatcctggtcggcaagccgatgcaatcactcttgcagaaccggaacgcaacggtaacgatgctatcggtccacaccaaggacgaagaattttacatgcggcacgccgacatcttaatcgtggcgattggtcacccccagttcgttaaggcccaagacgtcaaagagggcgccgtggtgattgacgtggggattaaccgcttagaagatggtagcctgtgcggagacgttgactttgaaaacgtgaaggaaaaggctagcctgattaccccggtaccgggaggggtgggaccaatgacgatcgctagcttgatggcccaaaccgtagacttagcagagtggagtgaagaataaatgatcgcggagaagaactgtttaacggtggcccaacttaccaagtacgtgaagcgcaagtttgatgccgatccctacctgaaccgtaacgtttacgtggttgggcagttgaccgactttcgcctgcgtaaaacccaccagtacttctccttaaaagacgatcaagccgatgggaagttccagctttccgtggtgatgtttcaaagtgcctttgccaaggttaagttcacgccggaaaacgggatgcgggtgatcattcggggacgcctgtccgtctacgaagcccgtggtaattaccaactctacgccgaggcgatggaagtgaccggggtcgggaccctgcaggtgcagtttgagcagttgtacaagaaactgcgccaagaggggctctttgaccgaccgaaaaaaacggtgcgccccttccccaagcggatcgcggtggtaacgtctaacgatgcggccgtcaagcacgacatcattaccaccgtccggcgccgtaaccgcctagttcaacttgttttttacccgacccgggtgcaaggggaacaagcggccggtgagatcgccgcccagattaagcgggtcagcgacgctaacgattacgatgccgtgattgtggcccgcgggggtggttctttagaggacctgtggccgtttaacgaagaggtggtggcccgggcgatcaaccaggccaacctaccggtaatttcttcgattggccacgagaccgacacgaccattaccgatttggtggccgacgtacggacggcgaccccaacggctgcggccgaggcggtgaccaagtggcccctggccgacgtcattgccgaagtggaaagggaacaaaccctgctgtataccgccgaaaagagccaactggcgaacctaaaacaacgcctcttggccctgaccgaaagctactttttgaagcaacctgagcgcttgtacgaacgccaggtccaacaagtcgatgaactaactggccgactgcagagcggggcccggttactgctagcgtccaggagccggcgggttcaagagctgcaaaccagcttggagcatcactcgccgcgggcccagctagctaagcaacagatgcaattagcccggttgcaacagggcctgcgtgccggaatgcgcgggcacttgcgcgggcacttggaagaagagcggggccgcttgattcgcttagaagaggggcgccgggcttcaactaacttgctacttcaggccacccaaaactaccaacgggggcaagcgcaacgcttagacacgttaataaagcagctggatgccctgagtccgctcaaggtgttagggcgtggctttgctttggtcaccaaggatgaacaagtggtggcgggcgttgaccaactggcggttggtgacgaggcgacggttaagtttgaacagggccaagcccaagtaacggttaccaaaattgaaaaggggaacaactaatggcaagtcaaccaaagagctttgaagaacaactagcgaaactacaagaaatcgtcaccaagctccaacaaggcaacgtgtcgcttaacgactcgattgaactatttaaggaggggatgaccctttctaacgacctgaaggggcaacttaatgaagccgaaacgaccctagcccagatgatggacgaaaatgggcagctgcacccggccgaagaaaagggcgatgacgtttcaaataacggggtgcaaaaccagggctacaagtcgcaattcttggatggggacgttttctaatggcacggcagttacaagaactagtggccgtggttgatgactacttggcgacccacctagccggcgcttgcgatcagccgctcctggaaaagagtatggcctattccctgttagcagggggcaagcgactacggcccaccctaacgattgcggttgccgaactgctgggaaagaccattgatgacgacttggtgcgggcggcttgtgctttggagctgatccacacctactcgttaatccacgacgatttaccagccatggataacgatgaccttcgtcgcgggaagccaactaaccaccgggtttatggcccgggggtagccaccttggctggggacgggttattaaccctcgcctttgagtgggttagtgataaccagttaaaagcgccagttcgcttgcggctggttcaagaattagctaaggcggcggggccagccgggatggtagcgggacaagccaccgatgtgtcagccaccggccaggagttatccttggcccagttaaagaagcttcaccggcaaaagacgggcgccctcttgcgctacgctgttttagccgggggcttgattgcggaacaagaaacggcggtgcttgattgcttaaccacctttggcgaagcttacgggttggcctttcagatctacgatgacatcttagacgtgacggcgaccacggcggaaatgggcaaggcgacccataaggaccaagctgagcaaaaaaacacctacccgggcttgttaggcttagcgggggccaaaggggaattagaggcggccttaaccaccgcccggggcgccgcggccgaactggggcgcctgactggtaaagagactgtaattttggatgattttttagcgtactatcacatctaggggtaaaatatggaaaaagaacgggtggacattctcttagtcaaacagggattgtttgattcgcgtgaacaagccaagcgggcggtaatggccggcgaaattttggggcttaacaacgagcgcctcgataaaccggggcaaaagattcccgtcaccactaccttacacatgaagggcaagaagatgccctacgtgtcacgggggggactgaagcttgctaaggccctccaagtatttaagatcagcgttgaaaacaaggtggtcttagacattgggagttcgacggggggctttaccgacgtcatgttgcaaaacggggctaagcgctcctacgcccttgacgtggggaccaaccagttagtgtggcagctgcgggatgacccccgggtggtggtgatggaacaaaccaacttccgctactcaaaaaaagaggactttacggcggggcagccggagtttgcgtcaattgacgtctccttcatttcactgtcgatgatcctacccccgctggctcagatcctcacccccggtggcgaagtggtggcgctgatcaagccccagtttgaagccggtaaggaacacgtcggaaaacatgggatcattcgcgagcgtaaggttcacgaggaggttttgacgcgggttttgtccttcatggccgcggatggctttgatgtcttaggactggactactcaccgattaagggggggcaagggaacgtcgaattcttggcgcaccttaagttggctacgggtcccgctcaaattgctcccgagattgatattaaccacgttattgacgccgcgtacgcagagttaaatagctaaggaggaacgtgcaatgaaaaaggtcgatcggcaacgccaaattcagcaaatcattgaagaaaacgatgttgagcgtcaggatgatttggtccgccttttgggggaagcgggcattcaggttacccaagcgacgatttcgcgggatatcaaagaaatgaagttgattaaggtgccgtcgacccacggcggctaccactacagcctccctaactatcaccaagaggataaagaagcgcaactgacggcgacgatcaagagcaacttggtggagctaaagcgcagtgaccgaatggtggggttggttatgcagccggggcacggaccgttaatggcgctgttagtcaattcccttaagttcccggaggtctttatggcgattggtgatgacgccaacgttttggtggtctgccaatcccaaacggccgccgcggaatttgaagaacggattgatagtcttcgttaggaagcgggggaaagagcgtgttacaagagttaacgatcgacaacttggcgattattgaccacctatccctggagtttgacgaccatatgacggtcttgaccggggaaaccggggccggaaagtcaattatcattgatgccgttagcctactggccgggggacgggggtcccaggagttcatccgcaagggagaagagaagctctccttgcaagggcagtttgaaattcccaaactgccgggttacgtcgccaaattagatgagctaggaatcagccacgacgacggggccttgattatttcccgtgaaatccaccgtagcgggcggaacacgatccgggttaacgggaccttggtcaacgccgccacccttaagcaattaggaagcgggctggttgatatccaaggtcaaaatgagcaccagttgctcttacgcccggaggcgcacttaggaatgctcgaccagtttgctaacgctaaggttcagcccctactagcgtcgtaccaagagcagtaccaagagtaccggcgtttggaggcggcggttaaccaaaagaaggccaacgagcaacagtgggcccagcgcctcgacatgttgcgctaccaagttaaagaaattggtgacgccgacttgcgggccgacgaagaagatgaattaatcgccgaacgtgagcgactggaacacttccaacagatcgccaccaccctccagcaggtggttggggtgttgaacgatgacgaagaggcgccggtcttagaccaggtcgccaccatcatgaatgcagcccaagagattgcacccttcgatcccgaatacgatgacctggcccagtccctttccgacgcctactattcactgcaagacgttgccaaccaagctggccaccagttggatagcctcgagtttgatgaggagcgactggccacgatcaacgcccgcttagcgacgattgccgacttggagcacaagtatggtgaaagcttagccgacgttttggcgtactacgaccagatcaaagaagagcttaccgatatggaggccgcggccgattcaggttccgatttggaagagcggttaaatgcggtccaggccgacttgttaaaccaagggaacgccctgagtcaagtgcggcaaacggcggcccgcaaattagccaagcaggttcacacccaactaaaggaactgtacatggataaggcggtttttgaagtgaactttgccaaaaccaagaagccggtcttctctgccaccgggatcgatcaggttgaattctacattcaaaccaaccctggtgaggcaatgggacccttggcccggatcgcctccgggggggaactttcccgggtgatgctggccttaaagacgatctttgcccagggcgaaggggttactagcatcatctttgacgaagtcgataccggggtttccgggcgggtcgcccaagccattgctgataagattcgcttgattgccgagggctcacaggtcctttgtattactcacttaccacaggtggcggcggttgcccaacaccacctcttaatccaaaaacgggtgcacgaccaacggaccacgactagcgtaacgctgttaaacactaaccaacgggttgaagagttggcccggatgctggcgggtgatacgatcaccaagcttgctcgcgagcacgcgtcggaattgttaacgatggctaagcaaaaggcccaggactaacgggaccgttctccttggtgtgaacaaaaaaacggctgagagaaagtagggtttctcttagccgtttttgtatttttgaaagcgggcaaggaaacacgttcttttaaggacgtgatgaattacggcacaaaaaaagacgtggtacagttaccacgtcttttttacttgaacgacaacttaaaaagtcgtcaggtcaagggtaacgctcgggccgaacgttgaagcgatggaagcgtgcttgatgtaagtaccacgcacagctgccggacgtgccttaacaacaacgtcttcgatcgtcttcaggttttcaaccaacttagcggtgtcaaaggataccttcccaaacggtaccgcaacgtttccgtcccggtcagtccggtaagtaacttgaccagccttggcgtcagaaacggccttagccacgtccatcgtcaccgtcccagtcttcgggtttggcatcaggcccttaggaccaagcacccgaccaagacgcccaacttgtggcatcatgtctggagtggcgatggcaacgtcgaagtcgagccagccatcttgaatcttttcaactaagtcttggtcaccaacgaagtcagcaccggcttcttgggccgccttagcgttttcacccttagcaaaaacgattacggtttggtccttaccagtaccgttcgggagcacaatggcaccccgaagttgttggtcagcttgcttagtgtcaacatttaagttaaatgcaacttcaacggttgcgtcaaagtttgcgaagtcgatttccttgaccaagtccaccgcagcgtcaacagcgtattccttcttgctgtcaaccttctttaaggcgtcttggtacttcttaccacggtttttagccatcttgtgttttcctccttgcaaatatgtggtcgaacggagttacctcccacgtaaggtcagcacgttttagcgtgtgacccggactgctgggtcttagccttcgacaacgaagcccatgctccgagcagtaccttcaatcatgcgcatcgctgcttcaacgtcagcggcgtttagatcttgcatcttcgtttcggcgatttccttaacttggtccttggttacagttgcaaccttgttcgtgttaggttcaccggaaccgtgttcaacaccagcggccttcttgagtaataccgcagcaggcggcgtcttcgtaatgaagtcgaaggaacgatcctcgtaaaccgtgattacaactgggatcagcatccccttttgatcagcggtccgggcgttgaattccttcgtgaagcccataatgttaatacctgcttgcccaagcgcaggacctactggcggagctggtgtagctgcaccggcaggaatttgcaacttgacaacgtttgctactttctttgccacgagacaaaacctccttagtccgtgttgtggtaatgatgggggattgaaatttgcccctcccacagtatgacgatagcataccgtattaatctagcacacccatcgcctaattacaagtcttattccaccgtatcgatctggttgaagtctagttcagtcgtcgtcaagcggccaaacatttcaatttcaacctttaacttcaacttgtcgcggtcgacttcgatcaccttcccggacaggtccgcaaaggccccggcgatgatcttaacgttgtcaccaactgcaacgttgatatcggtgcgggcaacatcttggcccatccgtactaggatccgatccacttcttcaggaaggagcggggtcggcttggatcccccaccgtgcgaacctaagaaaccagttacgccaggggtgtttcgggcaacgtaccaggcttggtcagtcatcaccatttcaactaggacgtaaccagggaaggtcttttcttcgacctcttttgcttggtcgtccttgacttggcgaaccgtttcttccggaaccaccacttggaagatgtagtcttccatccccattgattgggcccgggattccaagttactcttaacacggttttcgtaaccggagtaagtatgcaaaacataccaacgtttttcgtttgtttccacgatgtctctccttttagaaatgtttttggcaaaataaaaaaaccccgtccgcaaacgaagcttttgtccttatcaattagtatagcaaacttttggcccgctgactagctagacgaataacaacatcagaagatgaattagccagccaaagagggcaaagaagagaatgaaaaagatcgtaattgataaaacgatggtggtatcgcgccggttttcctttgccgttggccacaccacccggtgcatttcatccctaacgcttccgataaatttcaatgggtgcatgttttcctccaaaattagcgtgtttcccggtgaacggtcacttttccgcagtgcttgcaaaactttttgagctccaagcgctcctcgtggttaggacgtgcgggcacggaatagttccggcgcccgcattcgctgcactcgagggccacttttttcaccatgccatcgcctcccttatctgctctagattagcacgaatcacccggtttgatcaaccggtgtcccctagccaaggtgcttttttaacttcgcccgggcccggtggagggcgtttttcaccttccgttcagaacaccccattacctgcgcaatttccgttaagtctcggccctcactctctagtaggtaggcttcccgctcgtttgtcgaacactgggccaaaaattcctggtagctggcccgccacattacgatctgctctggggttagcaccggatcttggatcatcgtcacgtcgttttcggcgttgaggtcttgaaccagttgggcggggatccgcttttccgcccgggtttgccggtacaagtcgcgcaagcggttggtgagtaactggcggtaataccagcaaaaacgcgtcctttgttcctggcgataattgtggaccgcccggtctaaaaccaagaaggcctcttgttgccagtcctgacgatccaggttggcgattgagtaatttaaccacaaccgacgcaccagtggttggtagcggtcaaagagttctcccaacgtctcattatcacccttagtcgcaccattaatcaaagctaactccacccgctcttcatcacttaattgataggcttccatgaattttcctcccccgtatttattattctcctcccttgcaataaattacgttatcaaagtccggaagcgtttacaaatactgaaaatcgcgttttagcactttgtaaattttcatagccaaattgcgaaaatttggtttcgccaatttggctttctcgctaatcaacttacaaacaattaaacccccagcccaacttggactggggggtcgctttcgcttatttttatgtcgtcatgattagtcgagcgggtgacgagtggcaaagccctgataaattagtaaactagccgcaactgaagcatttaaactttgtacatgcccaatcatcgggattgttagcatctcgtcacaagtttttttcagtagtggagaaattccctttccctcgttaccaattaccagcgccacagcgcccttagcgtcccagcgccggtagtcagttccttgcatatcggtgccaaacagccaaacaccgcgtttttgcaactctttagctacctgaaccaggttggtcacccgggcgaccggaacgtgttcgattgcccccgttgacgtcttggctaccaccgaggtcaggcccaccgaccgccgcttggggataatgatgccgtgaaccccggccgcatccgccgtccgtaaaatcgaacccaagttgtgcgggtctgctaattcatccaaaatcaagaagaagggttcctcatccttttgggccgcgttttcaaacaggtcgtccacggtggcatattggtacgccgccacggccagggccaccccctggtggttttgcccggccgtcatctgatccagcttcgtcttgggaacgtttgaaatgaccaggtgccgttccttagccgacttcaccagctgagcaataacgtcggtctttaatcccttttggataaacaccttgttgatttcttggtcggactttaaagccgccatcgccgggtggcgcccaatgataaattcgctgttttcttcgttagtcttcatggattaggttcccccgttcaacttgcttgatgcaccacgccgccagttcggccacccgctcctgctgaccagctagttgcaagtagccaaacagggcctcaaacccggttgactgccggtaagttaagaccgaggtatttttggcgtgggtgtaactgttggcgttacgcccccgtttgtagtaggcccactcttcttcggtcaggtagtcttcttcttgcatcttgaggattagggccgcctgggccttagccgaaacgtagttagtggcctttttttgcaggcggttaggcttactcatcccgagggctaacaggtgttggcggatgaacacctcatagacggcgtcacccaaataggccagggcgatcccgttcaattgctgataatctgcttgttccattggtgactaatttgattcctttctgtaacgggtcccctggggggtgtcctctaaaatgatcccctggtcccttaactggtcgcggatctggtcacttaaagcgaagtctttttccgcccgggcggcgttgcgcttttcgatcagttccttaattttttcgtcgttaatttcagtagcggaaacggccaggtcaaccccaaagaccgctactaaccgttttaacattaattgaatggcaacgattggttcgcgctgcaccaggcgttgttcaacgtactggttagcaaagcgcatcaactcgtaaaccacggcaatcccgttttgaacgttaatatcatcatccatggctgccacaaagcgggcccggaagtccgctagttgccgttgcacgccgccatcggtcccggacgtagcgtctttgagccggtaagccaggttgtcgtaagtgttttttaagtgctctaagttagcttgggcttccaccaagctttcttgactgtattgaattgggcgccggtactgggtcgttgacatgaagaaccgtaacacctgcgggtcaacttccttaattaagtcgtgcaccgtgacgaagttgcccagggacttgctcatcttttcgttgtccctaccgatcgttacaaagccgttgtgcatccagtagttaacgaagcggtggcccgtcttggcttcgctctgggcgatttcattttcgtggtgggggaactcgaggtcctgaccaccggcgtgaatgtctagggtatcacccaggtacttggttgacatcaccgagcactcaatatgccagcccgggcgcccggccccccacggggagtcccacttgatctcgccgggcttggccgccttccagagggcgaaatcgagcgggtcctcttttttggccacctcttctgttgaaacgtgttcgctagccccgacttccaggtcgtctagggactgaccagacagttgaccatagtgggcaaacttgcgggcccggtagtacacgtcgcccccactttggtaggcgtagcccttttcaatcaggtcttcaataaaggaaataatcccgtcaatgttttcggttgcccgggggtgggtagtggcgggttcgacgttcaaagcggcggtgtcttccatgtaggcttggatgtacttatacgccaactctggcaccgtgatcccctgctccttggcggcctttatcatcttgtcatcaacatcggtgaagttggagacgtaattaacttggtagccagaaaactctaggtagcggcgcaccgtatcaaaggcgaccacgctccgggcgttgccgatgtgaatataattgtagacggtcggaccacagacgtacatgttaacgatccctgcttgttgggggtgaaattcttctttttgccgggtgagtgtgttgtatattttcaacatgtgattacctccagtggtcgatctagaatagtactatcttaccacaagttggacgggaccagtggcgaacccagaaatggggtttgataattattaagcacttagtcatactttcttcacaaccaactgatactatataaaccgtagcaaggaaacgagctacatttaaccgaaacctattatttttcaattactcctcccaatagtaaccgaaaaatatacttttacgaaatctcccccaagatatcgtaatactcctctgcggtggtcctcccaagccaccgcttttttattgccaaaaataacgcccagtgagcttcgttaaaccgaaccccactgggcgtttgttatttcttttgatcaaacgggtcccattcgtacttggcccgcgccccaccaattaacttgggccgggaacgtaagtaagtaacgtgggcctggccaatttctttgacgctggtccgcaccggaatctggacaaacttaacctgcatgccgatactggtgtcgccaatgtcaatgccggcctcggccaccacgtgttcaacttcaacgggatcatcaaagagttcaaaggccgccacctgtccggccccaccagcgtgcagctgcgggtaaacggtcacgatctccaagccccgttgttctgccaccgcccgttccaccaccagggcccggttaagatgttcacacccctgcacggccaggttaatccccctcggtgccaataattccacgatcgctttaacgaccgtccttccaatctcaatgttggaatcttggccgatgtgttcaccctgcacctcactggtgctcagccccaagacaaacaggtcgccacgctttaagtgggcggcttctaataactccgtcaccccggtttgggtggccgctttaatttgatttagtgactccataggctcccccttttggaacaaaaaccgtccctttgctggcttgctaagggacggtttttcaatgtgcttacttattttcttctaactgggcaatcatctcatccaagtgggccaaggtcttttcctgcccaaagagttcgatgctttccggtaactccggcccgtgcgtttcgtgggttacggcgatccgcagtggcatccagagcttgcgccccttcaccttggtactcttttgcacgtccttaatggcggctaagacaccggttgcgtccatgaagtccatggcggcaacccggtcccggaaggccttaatcactaccagggcggtgtcttcttgcatttcggccttcgcttcttcagaaatgtcttccgggccgttcacaaacggcttaacgtagtcgacaatttctcttgcgtaagaaatttcgcgcttgaagagttccactaaccgccgcatccattccatcttgtatgggttggcgttcttttcaatcaaaccagcgtccaacagctgtggcatggccacgtggaagacctcatcggctgacgaaagtttcatgtactggttgttgatccactggagcttcttgcggtcaaaggcggctggtgacttggacagccgcttttcatcgtacatcttaacgaattcctttaaggagaagatttcgtcttccccaaccggggaccagcccaagaggatgatgaagttatccattgcttccggcaggtaccccaggtcgcggtattgctcgatgaattggagcaccgattcgtcccgcttggaaagcttcttaccggtttcgttattgatgatcaaggacatgtggccaaattccggtaccttccagcccagggcttggtagatggccatttgctttggcgtgttagaaacgtggtcatcgccgcggaacacgtggctgatcttcatcaggtggtcgtcaatgacaacggcaaagttgtacgttggcatcccgtcgcgcttttggatgacaaagtcgcccccaattgattgggcctcaaacgacatgggtcccttaaccaggtcttcccattcaaagacttcatccttaggtacccggaaccggatgaccggctttaatcccttttcttcggctgcttcttgggccgccttgatttggtcatcgctcatgccggcatattcgtattcatagtgtggcatttggtgggccgccttttgggcttcccgttgggcctccagttcatcttcggtcatgtaggacttgtaagccaggcccttatccattaattcttgaatgtattgggcatagatgtccttacgttcggattggcggtaaggaccaaagtcgccgcccttatccggaccttcatcccagtccagccccatccacttcaggttgtcgagctggctgcgttccccgtccgcaatgttgcgcttggtgtcggtgtcttcaatccggatgataaactttccgtggttgtgccgggcaaataagtagttgaacaatgcggtccgtgcgttcccaatgtgtaggtgtccggtcggactaggagcgtaacgaacgcgaatttcattctttgacaagatttccgcctctttcgtaaaaataagtgtttcctaactagtgtagccttccccccttaaaaagaaaaggctatttcttggattgttccttttgaccgtggtgatgaccatcaattcccttggtggaatgcaggggacgggcaaatatcatccgcccggcgtcggtttgcaacgccgaggtaacctccacttcaatccgttcgttcatgaagtagcgaccgtcttcgaccaccaccattgtgccatcatctaagtacgccaccccttgctggcgctcggtcccctttttgaccaccgttaccgttaagtgttcacccgggattacccgcggacgaagggacttggccaggttgttgatgtttaaaacctgaatgttttgaaactggatgaccttgtttaagttccagtcgttagtcacaattaccccatccacctttttggccagggcaatcaacttggagtcgacctcgtcgatgtcatcaaagtcgccctcgtacatttcaacgggggcaatccgttcttcttgaagcttatttaaaatgtccaagccccgccggccccggacccgcttgatcgagtccccggaatcggcgatgtattgtaattcatacaagacaaagttagggaccaacagcgttccttccaaaaagccggtcttaactaggtcgtaaatccgtccgtcaatcaagatgttggtatctaaaatcttatagtggtggtagttatcgtcttgacgtttaataacttgactctgcgtatccttatcgagatcgcgccgcatacctaagaggtttcgccaatcatcgagccgggtcgtcccgatccgaaaaccccaataagaaaagaccaccattaacaaaaggggcaaaatattattcaccaccggtactcgcgtgcgccagagaggaatggaaattaaaattgctaaaataaggccgacaatggtggccagcgccccaaagattaggtaaatcgggttctgcttagctagggcttgttcggttcgtttcatcaggctggcgacccagtcggctagggataacgataataagaaaaagagcaccgccccgattaccatgtccacaattgccagcaacgaagtggccagcttaaagccaattgccgcccacaacagtggcaggtagtaaaagccaatcgccgcccccacaatcgtgaaggctaaccgaattatccgttttttcattattacaccccccttcgctaccaattttacccctatccaagggcaattttaagtgcttcgccaagggtcgttacccccacgacttcgatgtcttgcggcgggttccaacccgctaaattgtttttgggcactaaaatccgcttaaagcctagtttagcggcttcggccacccgctgttcaattcggctcacccgacggatctccccggttaagccaacttcaccgacgaaggcgtcggtcggccgggtccccttatcccggtaagaagaagcaattgccaccgcgatcgcaaggtcgatggccggctcgtctaacttaacgcccccggccgccttcaagtaggcatcctggttttgtaagagcaggttcgcccgtttttctaggaccgccatgatcaaggaaacccggttgcggtttaaacctgtcgccgttctttgggcgtttccaaagacggttggcgtgatcaaggcctggatttcaaccaggatcggtcgggttccctccagggatacgaccacggccgacccggtggcatccttaagccgctcttccaaaaagatttccgaggggtttgcgacctcggtcaaaccgcgggtattcatttcgaagatccctaactcattggtggacccaaaccggtttttgaccgaccgtaaaatccggtaggtgtggtggaggtccccttcaaagtacagcaccgtgtcaaccatgtgttccaagatcttgggcccggctaagaccccacccttggtgacgtgaccaaccacgaagaccgtgatgttttgccccttggcaatctgcatcaactgggcggtgaccgcccggatttgggagaccgacccaatcgccgaggtcacgtcggccgcctgcatcgtctgaaccgagtcaatgattacaaactcgggctgaatggaatcaatcgtcgcccggatggcttccatgttggtttccgggtagatataaaagtcctcgccggaaacgtctaagcgttgggcccgcaatttaatttgggaggccgattcttccccggaaacgtaaagaaccttgtggtgttccacgctcagttgccccgacacttgtaagagcagggtggactttccgatcccgggatccccaccaattaagaccaacgagccgggtacaattccgccacctagcacccggtttaactcatttaagcgggtcttaacccggggcgtttttttggtgtcaatttcttggattcgctggggccgggccacaatcccggttaaggttgccgtagcgtttttagccgccggggtacttgcctgctcgacttcttcaactaaggtactccactggccacaattgggacaccgccctaaatagcgcggtgaattgtaaccgcagttttggcagacaaagtgtgttttggcttttgccatcctggttcctccctattgtttcgtggaaccaaagcccccgcttctctttgcctgtggaacctcctcttggtcggccaccaggtaagggacaaagattccctgggcgatgcgttcgccctttttaatgtgataatcgcgcaggccgtaattgaccagctgaacaaagatttccccttcgttggcggggttatcgtagtaatcggcgtcgatgatgccaaccccgtttggtaaaatcaaccgccgctttagggggccactggaccggttgactaagattaagacctcatctggttgcatataagccttgattccggtcggcactaagtacggctttagtgacttatcggcccggtcaagctcttctgtcgtcaagtagcgcttagcttggcgaagcttgtacagggccctaatgaagttacccttccaaattgaaggaagggtaaagtccgttgccgccgcaaagtcgtaaccagccgcctgctttgtttgccgcttaggaagggttaaccccgcctcttgataagtagagaccacttggaacccacgtttcatttcgttcacctcaaaatcaattttgttattcgattgtaccatggtttcagacttggttactccctaaacgaccatcaaaattcaagacccagcttggttcggtatggaaggggttttgctcctgagttgacatttgaatttaaagcgggcacaatttaggcaaaggcgtctaacgcttgttttacaaggaggtaaaacgatgcactacaaatacgaaaataacgttttaaccgtgactaacgatcagggcgaatacgtcggcgaacttgactacccggccatccctgattacgacaaccgttacgctatcgaacgggtcttcgtcgcttccacttaccggggcaccggggtggctagcgacctagtcaagaccttcgtagaacacgctaaagaggagggctgggtgattaaactaatgtgcccatacgccgtggctcagttcaagcgccaccccgaataccaaaaggtcctcttgccagaagatcgcttccccaccacttttaccggaaaattgcttctcccgccccctttgacttgtcaagctactattagattaagccccgttcaactaagcattcggcgttttggaccgcgttccacgccgcccccttcaagaggttatcggccacgatccacatgttaaaggcgcccttgttttcgtaatcgggacggacccggccaacgaagacgtcgcgcttcccctctgcggtcagtggctgtgggtaaacctggttagcgaggtcgtcttggagcacaacgcccggcgcgttttgcagcagttccttaatttgatcagccgtggcgctttggtcttcgacttcaaagtagaccgattccccgtgggaaatccccaccggtacccggacgcaagtggccgtcacctttggctcagccgcgtccatgtcaccgaccatgatcttcttggtttcgtggatcatcttccattcttcgtgggagtagccggagtcttccaggacgtcgatttgcggtaggaggttaaaggccaacgggtagtggcgcttgtcgcccttggtcggtaaaatctcagccgtcattttcttaccagccaggtagtcttgcgcttgttggtagaattcattgagtgccgactgaccggccccggaagcggcctggtaggtagacacgatcacttgcttgagcccaaaggcctgacggatcggctccagggccaccaccatttgaatcgttgagcagttcgggttggcgatgatgccgtggtggttatctaaggcctccgggttgacttccggtaccaccaacggcacgtccggatccatccggtaagccgaagtgttatcaacgcagaccgccccgcgcttgacagcttcgggcaagaacttcttggaggtgctccccccggcagaagaaagcaccaggtcgaccccttcaaaggagtccggggtggtttcttcaacctccacctcctggccccggaaggtcagggtcttccccgccgaccgggccgaagcgagtaagtgcagctccttgaccgggatcgatgattgttctagttgttggatcatgcggttcccaaccgcccccgtggctcctaaaattgcgaccgtgtattcctttgacatagtatcttcctcccttagttaatcgtttgaacaaatgcttcgaggcggttcatcgcctcttcaatcttttcatcagcagcggcgtatgataagcgaacgtaaccttcacccccgtcaccaaagacggagccggggattaggccgacccgcccttccttggctaggcgcttagcaaaggcaaagtcatcgctaccaaaggcggccgggatcttagcaaaaacgtaaaaggcgccctgcggggtggccatttcaaatcccatcttacgcatccggctcaccatcaagtcccgccggcgccggtaggcctcacggaattcaagcgggtcgtcttggccgttttccagggcctcgaccgcggcggcctgggcggcgtcgttaacgcaggtcaccataaacgagtgcatcttagtgatcggggccattaagctggccgggcccgccaggtaaccaagccggtagccggtcatggcgtgggacttagataaaccggaaatcagaatcgtttgttccggcagccgggtggccaaggaggcgtgttcctggtcgtacaccaaatcagagtatatctcatcggcaatcaccaagaggtggtgttcttgtaagaccttggccaactggtcaatcaattccgccccgtacgagcgtccggttgggttagacgggtagtttaagagaatcgccttgacggccgacccttcctcttttaagaccgtctctagccgctgtggggttaaaacaaagccatcgtcggccgtgttcaccatcaccgggattgcccccgttaaggaaatgatcggaaagtaaagggaaaagaccggggtcgggaccaaaaccttatcgccgggattcaagaggccaaaggtcgtcgccgtcaacgcctccgttgcccccacggtgaccgttacctcactcgcccagtcgtagtccacgccacgggtcttttttaacaccttggcaattgcctggcgcaattccggcttgccggctgaaggggcgtagtgagaatcgtcgtcttggatgctcttgatggcagcctccttgacgtgttcgggggtggcaaagtccggttcccccagggttagcttgatgatcccgtcgacggcggaaatctcgttgtcaaaggcccgaattgccgacggtggcacctgggtgagcttttgattttgcaacccggttagttcttgaatcacttctggcatctctgttcctctcttttcactcgtttacaagacgttttctaaaccgacgaccaattccgtcagggtgccgaccttttccaaacccaccttgaccccgctcataaacgacgagcgatcaaaggagtcttggcgaatggttaaggcttcgccactgcccccaaacaagacctgttcgtgggccacgtagcccggcaagcggaccgcgtggagcttaattccttggtaatcgccgccacgggcccccggcaggctttcggttgagtccggcgccgtttcgtgggccggtcggttttcgctaatcagcttggcggtcgccagcgccgtcccggacggggcatcctttttgtcttcgtggtgcatttcgatgatttcgacttctgggaagtaggcggcggcttccttggcaaacttcatcaagaggaccgccgacatcccgaagttgggtgcaatcaagccccccagcccgttttgcttggccagttgctgtagttcttcgacctgttcgtcactcagcccggtcgtccccaccaccggggccatcccgtggcgcagggcgtacgagacgttttcaaacaccgccgctggcaccgtaaagtccaaccagatgtcggccgcccccgtttcaacctgctcgcggtcggcgtaaacggtcgttgaattttcaaggccgtagcttgtcggatctaggtcggtcaagtggtgcccaaccacggcgctcaattcaaagccggggagcgattttactaatgcgacggcctgttggcccatcgccccagcaaaaccggcaattaatactttagtcattggtaagtccctcccctaagtcggttggtaattgacccgccaaggcgtcgctaggtaaccccagggcggttgccaattgctccttttcttctccggtcaggtcgcaaatcggcaggcggcagtggtcggtgaccaacccctgggccgccaaaacggccttgaccggggaaggcgacgggaacatgaacaaggccgccatccgcggggtcaaccagcgttggagcttagcggccacttggtagtcacccgcactaagggcgtcgtacatggcccgcatctgcggcgcatagttgtgggcggccacggagataaccccgtccccccctagtaccttagtggtcatggcctgggcgtcttcaccggtgtaaacggcaaagccggccggccggttttccaccagggtctggaattcttccaggctggcacactgcttgatcccggcgatgttggggtgttcagccaggattaagacggttgaagtttccatcttgaccccggtccgccccggaatgttgtaaatgatcagtggcaattcgaccgcgtcggcaacggccgtgaagtgggctaacattccccgttggttgggcttgttgtacggtggcaccaccactagagcgtagtcaatcccctcgatttgggccacctcgttggtgaaggcgatcgtttcggccgtgttgttagacccggtcccggcaatcaccggtacccgaccggcaatcaaccgaccgaagtgggtgtagagttcaatcttttcgtcgtgggacagggttggcgtctccccggtcgtccccccgacgacgaaaccgttgttaccggcctgcaacaggtgctcagttaattggtccagggccgggtagtcaatcgtcccctcgtcggtaaacggggtaacgatggcggttaaaagatcggcgttggtaagttctgtcatgattagtcctcctctgcttggctgcggtaggtgataaagctggttagcgcatcaattcccttttgaatcgccccttcattgggggtcagagtggcttggtgaagctgggcatcgtcttcaacccccagccaaaacatcgtcccggggaacttggacaacaagtagccaaagtcctccccggtcatcgccggcgccgtttccacgtagtcaacggccgggttgttttgcatgaagttaatgaaacgtttggtcagggcggggtcgttttcaaccggcaagtaaccgccctggttcagggccaagttgaccgtgacgccaaaactcttagcaatcccctcacagacgtcttgcaggcgtcggtcaatcgtttcgatcattccctgggtcaacccgcggatcgtcccttcgatccgggcgtggccggcaattacgttgcggatggttccggcctctaacttacccagggtgatcaccccggcttcgaccgggttaatcgaacgagagataatcgtttgcacctgcatgattagggccgcggcggccaccaccgcgtcgttggcctcctgggggaaggcggcgtggccgtccttacctaagacgtcaatgtcaacttcggtcgtcccggcaaacagggtccccagccggcagccaatcaccccggttttcaaagccgggttatcgtgcaggccgtaaaattcgtcggggcgccacttaccttcaaatagccccagctcataggcccgctggccccccgcctcactctcttcggccggttggaagaaaaagagcaggttatccttgggttggtggctggcaaagtagtccaagacccccagcgccacggtcatgtggacgtcgtggccgcaggcgtgcatcaccccggagtgggtagaggcgtagggtaagccggtctcctcttgaaccggtagggcgtcaatatcggtgcggtaaccaatcgttcggacgggcgccgtaccgttcacccggaccaaaatggcggtcggcaagtcctccggttccaagatttccaggtgatcttgctccatcttcccgatcacctccattaggtaggcgtgggtctcagtttcctgtagggctagttcaggaatctggtgtaagtggcggcgaatctgaattaactcctccgtgcctaacattagagcttcctcaaatcgtcttccagcccggtcttggaatcggtctgttcgtcaacgtccttaatgtagcgggcgggcaccccggccaccaccgtgtgcggcgctacgtcttgggtcacgaccgccccggcggccaccacggccccttccccgacgtgaactccttcaatcacgaccgcgttggccccgatcagcacgtcgtcatcaatccggactggttcggccgacgccggttcaaccacccccgccaaaacggttccggcaccgatgtggcagtgcttaccgaccagggcgcggccaccgaggattgcccccatgtcgatcatggttccctccccgatttcggccccgatgttgatgacggcgcccatcatgatgaccgcgttatcgccaattaaaacctggtcgcgaatcgtggcccccggttcaatccgggcgttaacttcctttaggtccagcaacggtacggcggaattacgggccgcattttccacccggaccgccgcaaagtccgcttcgtgctcggctaagaagggctttaagacctgccagtcgccaaacaggaccccggtagtttgttccacgaaggcctctacttcagcgggaaacgtaagtgcttttaagtcagtccccttaacgtagaccttaacgggggtcttcttgggcgcggtaccgatgtagttaatgattgcttgcgcgtctaattgtgccatgtgaatttctcctttttcttcctattatttatcttcacttgcgagcggtaagtcgagccggcaggtatccgcccagctttcgcgttggatgaccagttgagcgtggccgttttcaacgaagaccaccgccgggcgggggttccggttgtagttagaggccatcgcgtacccgtacgctccggtgtctagcattaccaagaggtcgcccggcttggttttggggagggcctgatctcttgctaagatgtcgccggattcgcaatacttaccggcaatcctgacggtctcttccggtttttgacgggggtctttagcgtacaccgtttcgtaagcggcctggtaaagggccgggcggatgttgtcccccatcccaccgtcaacggtcacgaagggctggtagcccgggaggtcttttcgtgaaccaaccgtgtacaggctgtagccggccggtccaacgatcgagcgccccggctcaatccaaatcgccggcattgacaggccctttttggcgacctcctttttaacggccttgatgattgcatcgacaaattcttccggcgggagcggttggtcttcttgaacgtagcggattccaaagccaccgccgacgtttaagacccgcgtttgaaagccaaactcctcgtgccagtgctcggcgacgtccactaacttcttggccaccccttcaaagcccacgacctcaaagatttgggagccgatgtgggcgtggaggccgaccaccttgagccgggggttggccaagacctcttctagggcccggtccgcttgccccgattccaggtcaaagccaaacttggaatctacctggccggtttgaatgtactcattggtgtgggcggcaatcccgggggtgatccgcaggctaacggtcgcggtggcgtcttgttcatctaagacctcgcccagcaagtcgatctcgtggaagttatcgatgatgatcatcccgaccccgttttggacggccaattccagctcttctttagacttgttgttaccgtggaaactaaccttttccatcgggaagtgcgccttgatggccgttgttaattcgccaccggagaccacgtcaatgtggccatcctcttgggccaccacctggtaaatggcgatggcgctaaaggccttgctggcgtaagagacctccgctgccacctggtttttggcaaagacctttttaaaggcgcggatttgatggcgaatcgccgctacgtcgtacacgaccaggggcgtttggtacttggccgctaattcaaggctgtcaacgccgccaatcgttaggtgcccctgatcgttaatctgttctggttcaatctgtgaattcatcttagttccccgtttctttatcggtatgaaaaaaggctctgggtgcggtgcgcatccagagcccaaccacccggggtggtttattcagccgtaattgatagcgcaccgcaggctctcattgtcccgcgacagtccgcagcctcttaagccacgccccagccccagggaacggtcacttccccgtgcttcggcaaccgcccctttcactccccctccttgcctgacccggctcttggtagctactcatgttggttgcgcctcttcaatttattggtagtttataattatttacccctgccgtcaaggttttttaattttattctcatccataagtactttcaccccttgataaaccgcgcctaaagccgtattagcgaagattgcaaaaagatttaggacttgcgtcaattaggagccgtgttaaaatccaattaaaaatcaacgccctaaactggcaaaaggagtatttttatgaaggttgtaaaatttgggggaacctccctcgccgacggagcggcctacgaaaaggtcgttaagattattcaagacgatcccgaacggacggtgattgtcacctccgccccggggaaacggtttcagggcgacattaaggtaaccgaccttttgattcgttacgctaaccaggtttgccaaggcgaagacgccacggccaccgttaaggaaatcctcggccgctattcggaaatcgcgactcacttcggtttacccgccgtggccctcaccccgctgcaagcggccctagaggacttacccaagcaagactatcccaaccaagattacctaatggccgccttcaaggcccacggtgagcgcctcaacgcccgcttaatggcgttggtgctgacccacgtggggatgcccgcccgcttcgttgaccccagcgagtgtggccttgaggtgaccgggacgcccaacgacgctaccgttagtccacacacttacggcaacttgcacgcctttaagtacgattccaaccagcgcctcgtcttcccaggctttttcggcttcacgccggccggccggattgcgacctttgcccgcggcggttccgacacgaccggggcgatcctagcttgcggtctgcgggcccgcttatacgaaaacttcaccgacgtggacgccatttacaccgctaaccccaacatcgtggacaacccgcagccaattcgtcagatgacctaccgggagatgcgggaactttcctacgccggcttttcggtctttcaagacgaggccttgattccggcaattcaaggccaggtgccaattaacgttaaaaacaccaacgccccgcaaaagccgggaacgatgatcgtaccggaaaagggctttaagccagaggacatcatcaccgggatcgctgggggcgcccactttgccgccctctatctgcacaagtacttgatcaacaaggaaaatggcttcaccctccgcttgctttcgatcttgcagcgccacgggatttcttacgagcacatgccatccggaatcgacgacgtgaccgtgatcatcaaccgcaaccaaatttccgacgagcaaatcgatttggtctgcaacgagatccaatgcgaaattaaccccgaccaactcaaatggatccccgattacgccatcacgatgatcgtgggcgaaggaatgcggaccagcctcggcgtgattgaggacgtcttggcgcccctagcagaagcccacgtcgaagtgccgatgatcaaccagggggcttcccaaatctcaattatgatcggcacccgggccaaggacgccgacaaaaccgtcaaggccatctacgaccgcttctttattcactaacaggaggaaaccatggcacagttactaaaggttcacggatcacaaaaccaattcttcttactcgaccaaaccacccttgcccgcccgctttccgacccggaactaagagcgctgggccttcaattatgcgatccagctatcggaattttaggtggggccgatggcttgctcgtggttaacgacagcaacaacccggccgccagcggccaaatgcgggtgatcaacgccgacggatctgaagcctcgatgtgtggcaacggcctgcgcaccgtcgcccgctacctagccgaaaaaaccaaccagacccgcttccaagtcgaaacgatgaaggccgacctgaccgtggcctaccacgacgacttcttccccggcgtgccgggctacgccgtcgaaatttcaccggtccgttttaacaaggaggcccttccctttgaccaggttggccacgaacggcttttagacaccctggtgccagagtttgtgcccggctggcgcttctccgccctggcggtgcccaatccccacctgatcgcctttgtcagcgacgaagaactcgccgggccggtattgggggaactgggccaacgcctcaacggggagaacccctactttgcagacggggtcaacgtcaacttcgcccacatcctcggtcccaacgaactcttcgtccggacctatgagcgcggggtcggcttcaccaacgcctgcgggaccgggatgtcggcgacgaccctggccttcgccctaacccaccccgaccaggctggctttgagaccccaatcaccgtttacaaccccggtggcatggtcaagacgatcctccaccaccatgacgcccgttacacgattgacttaatcggtaacgccactttcaccaaccaaattgaagtccacgaggccgccctccacgacgcccaggtcaccgatgcagacgtcaccgtgaccgaaaccggcgagcaggccgcctacttagacttcgtcgcgagcctgccccaggtcagcaccgttaaaagcaagtaggagggaaatcccttaaccaactaaaataaaagaggctggaaaatctgcttttccagcctcttactgtatactcaaatgttagacagaaaatgtggtaaataaccgcaggcctagtgccgaagaacggtgcgtaccgcaccaaccgttcgccctagcttagtcatacgacctgccaaggaggttatttcccactctcttccccttaccgcaactgaataacggtgccgtcgtcttcaatcaacaccccgacggtctgctcgagggttttgacgacagcggcgatctgctccttggttttgccaaacagcatcgtcgtccacagttcccctaaaaaggcggtcggcgtcaccaaggacattgacgccaccgtcgtctcgtccgggtagccggtctgggggtttaggatgtgatggtaggttttcccgttggtggtcaacttgcgctcggcgacccccgaagtggtcagggcctggtccttgatcgaaaccacctggccataagcttgggccgggtcagccgggttttgaatcccgacgtgccacatcccgtcttcattctccgggttaccgcccaggccaatcaccgttgacccaccgaggtttaacagggccgattcgaccccctgttccttgagccaggcgatcacctggtccccgataaaacccttggccaacgcccctaagtcaatctccatgcccggtcggttgaggctgaccgagtgggtaacgtcgtccagggtgatttggcgcgggtcggtcaaagcaagggcccggtcaatctccgcttggctgggcacccgggcgtcttgaaagccgatgtgccacagcttgaccagggggccaatcgccacgttaaggttgcccccggggtacttgctgtagtggacgccaagcttaattaattgataaaggtccggcgccgcttcgactggcccctgcccagcactcgcgttgatcttcatcagatccgccgactcatcgttggccgaaaaacggtgctccgccgcccttaattgttcaaccacctggtcggcgagggtcccggcgttggggccaccgttgatcaccaacgtaatcaccgtccccatcaagtgaaccgttcttcctgcttgcatgccaatccctccgttcttgttaccctaaataataccacactactcgcccctaactatgctataatgtcattaatatcttacaagtcggtaaagctagagctctatcgctagaatgtataatatggggttccctctaattctggtcgaagttcgtttgtggaaacacaggtgggctttaccgcagaattggaggtttttttctttttaagtcaagaaagaggtttagtagtataatttaaattgtttaattgctattggaggagttgtagtataaatggatttcattagtcatacggtggaggggtcaacagacgttcaactcctgagggaacatctaatcaacgctaaaaatttggcagaggattatgggacagatattgatattcctaaagtaacgggcctagcagccttactccatgatttagggaaatatcgggtggcatttcaagagtatattcaaaatggtgttggtcaccatggtagcgtagaccattcgagttttggtgcttattttattcatcaatttattaatgaacatagccaagcagaatcagaaaaagatcgtttgtatctcacttggtttggtgaaataattgaaaatgcgatcatgtcccaccacaattcactgggacttaaggattttgttgacgctcatgtgaatagccctttccttaaacgattaaataaagttgaggaggatccagaattaaaggatgagttacagcgggtaattcaacgctttttccaggaagttatgggagagaaagagattagtgattatttcgatcaagcctacaaggaattctccttgctcatcgataaatgctttagtcaagataagagaacactattgagcaatctgttttttatcgaaacgtatgtttactcttgtgtacttgacgcagaccggacagataccgctacctttagtttagaccaaccggtaaaacgctatgactattctgcggtttttgaggattactatcaaaaacttaatcgacaactagcagggatgaatagtgaaaaagagattaatcaattaagaagtgcaatgtctgatgaatgtgatgactttgcggaaaaaagggacggtatttaccaactttcaattccaactgggggcgggaagaccttagcggggatgcgctatggactcaaacgatcaattttaagtcataagaagcatatctttggtgtattgccattcatcacaatcattgaacaaaatgctcgtgtctaccgggaaacttttaatggtgacccgctagataaccagaacattctagaattccatagtaatgttgcacaggaactacgatctaataaggaaaaagatgatttgctggatcttgctgaagatagctggaattcaccgattacggttacgacaatggttcaatttctaaattgtatttttgctagtgggacaacaaatcggcgccgttttcataatctctgtaattcggtcattattcttgatgaggtacaaaaagtgccggttaaatgtttatccctttttaacaaagcgattaatttcctgaaagaggtcggtcactgttcaatcttactttgtacagcaacccaaccagcattaggtgatttaaaggctagtttaaagattgatggtgagatcatccaagacctttcccagcggcaagaagattttaaacgagttaagtttaccgacttaactaggcagggaattcaggaacatccaatctctagtcaagaattagcggaactaattacttataaatttaatgatagccaacgcattctagtcattcttaatacaattggcgcggttaatcagctagcagagaatttagacagtgggcaattgaactgtaaggtatatgcgttaacaaccagaatgtgtgctgcccatcgccagaagctaattaatgaaattaaggatcggctagcacaaaagttgccaaccatatgtgtttcaacgccattaattgaggctggggttgatattagttttgaaactgtttaccggtcggtatgtggattagattcgattgtccaggcagcgggacgttgtaatcgtaacggtgaaagagatcgtggtgatgtttatttagtccttctgaataaggattctgaaaagttagataaacttagggagataaaatggggacaaaaaatcgttcttaatatgctggcccaaaaagattttgacccagacagcctgcttcaaaccaaggtgattaataattattttgatcacttttatcaagaaattgatcaaagtgaattaagcggttatccaacaagtgacgaaggacgagatattcatttggctgactatatagaaggaaagcaagctagtagagattatctacaacagaattcaggatcggaacttaaagctttttccgggagtgaaaccattgcaaagcattttgaagtgattgaccaggaaactgtttcagtattagttccctatgggaaaggttccgacctcattgctttgctgaatagtcagaattatcaagattcattgtcagaaatttttaaagaagctcagccatatttggtaaatgtctttaaaaatatgctacgaggcttaattgagaaagaggtcgtgtacccgattgagttcccattttcagatcgggaagtttacgcagtaagggatagttactatcaggaagaatcaggtttgaattatcaaattaaaaattcagagtcaatgattttttagaaaggagaagcaatgagtttaaaggaaaggacaacattttgttttcaagtagatggagactttgccttgtttacggatccgattaccaaaattggtggtgagaagttcacctatccggtgccaacttatcaagcattgaaagggattgccgaaagtatctactggaagccaacctttcagattgtaatagataaggttcggatcatgaaaccgattattactgaagcaagggatatccgcttaatgaagtacaacaggactggcgcaagtgatcttgctcggtatacctatttaagagatgtttcatatcaggttcaagcccacctagaatggaatgaacagcgattagatttgatgaaagatcggaatgccaataagcattatgccattatgaaacggtcaatagcgcggggcggaagacgtgatatttttcttggaacccgcgagtgtcaaggctttgttgaggaatgtcgatttgggcaggggtcaggatactatgatgactctgatgatcgtttgtttggaaccatgctacacggctttgactatccagatgaaactggggaagattacctaggtttgcggctatggaatgtggtgatgaaaaaaggaattattgaattcccgccaccaatcgatctacaattacacagaagaaaactacatgagctagaggcaaagaaatttacactggatgatatccaaagtgttgatgacacttatgaagaattattagggggtgaggatgaatgagttggatgtcagaattagttgatttgtatgatcgtaatcaaaataaagcggggaaagtaactaatgtaaaaagaagagggaagaacggcgaaacagtgttgaaacccgtttttctattaccaattaatcatgttagtaactacgtggagattgaaattaaattaaatttagacggtgattttgttggtgctgaagtgatcaacaaggaaaaaaccattatgccagtcacaattgaatcagctgcgcgaacaagtggaattagacctagaccagttgatgataaatttcagtacattgcccgagattataatcaacttcaggaggtgcttgaagctaaacgggaacctggtgagcataaagataaaccgtataagcaagacggcgactttgatgagtatttacaacaattaacagatttttttgaatttactaaagagcattcaaaaacggttgcaccactccttatggcaattcaaaaatatgtggcgaataatgatttaatcattgatttaattcatagtggtcaatttggagaattggattcatatgaggatatcgacgaaaaaattattttagctaataacccactctgtagatttaatgttctcactgaaggacctgtacggtggaaaaatccagaatgctttaaagcgtggtcagatttttatcaatttaaattggctaaggaggggaaaactggatttgattatgtagccggtaatgagcatgtccccttaagtacaaaccatcctaaagggattttaccattggcaagcggtgctaaacttatttcttcaaatgatacccaaaactttacatttagaggtcggtttattaattccgaagaggccgtttcaattggttatgagtcatcacagaaagggcatgctatgctaaagtggttgattgataagcagggattttcaattggtggccgttattacattacgtgggggacaaccggagaaaacttaactacaattaatcctcaagacaatgaattatttaatgacatactatctttagatgatgaaatagaggatactaatagtgcatttgcaagccagttgcgtaatcttttacttaagggagctagtgtaaatgggattccaaaacaaaatccggtttacgtaatgcagttagaagggacgacgacgggacgatttggaattgtatattaccaagcacttgatctaacaacctatattgagcgaattactgattggtatacgaaattatatcttaaatttgatgataataaatatatttatccaagtctaaaattcatagcagatagaatttatggcgatcgtaatgacgaaactactcagaaattgaaaaaagatgtagttaccgatctagttcaatcaatattgggtggaagaaagatttcttacagttacctgagtaagatcttccaaaaatcgattcgccctactagttttgataatcagtcatcttggaaattaacggttacaaccgctgcaagactattcaaaagttatttttctagagaggaaattgaaccaatgttaaatacggattttaaagatcggagctatttgtatggtcggcttcttgcaattgctgatgtggttgaacaaggggttcttggagctaatggtcaagatcgttcgacaaatgcacgacgctatatgtcagcctttagtcaacgaccggccgatacctggaaagtaatttatgttaacctacagccatatcttactaaaagcaactatcggcaaaaggcacaaaggctatttgatgaaatcaatgaaaaatttgatgtcacagattctcagttaaattcaccgctcgatgggaagtttttaattggatatagccaacaacgaactgactggtataaatcaagcaaaagtaagagcgaagtcgaataagcaaaataaaggagtagagaaatggctgaagtattaaaccaccggattgattttaaagttgttattgcggcggctggggcaaatcctaatggtgatccccttaatggtaaccgtccccgtcaaacgagtgatggatatggagaaatctcggatgtagcaattaaacgaaaggttcgtaatcgtttacaagaccttggtaacaaagtgttcgttcaatcggccgaccgagcagacgatgaagctaagagtcttaaagaacgagttgagagtaatgatgaattaaagaagttgatggatgatggcgataatgaaggttttgaagaagccgctgataatacatggattgatgtacgaagttttggccagatctttgcatttaaaggaaagggcaagagtaaaggatttagtgttggtgttcgggggcctgtatcgatcacgcgagctcgatccattgcgccaattgccatcaacgacatgcagattacaaaatcagtcaatgatgaaacgactgaaggtcgcggatccagtacgatggggatgaaatacagtgtagactttgccgtctatgaattcagcggatccattaatgtgcagttggccgaaaaaacgggcttcactgatgaagacgcaggaatgattcatcaagccttagaaacgctttttgataatgatgaatctagtgctcgtccggcagggagcatggaagtattacgggtttactggtgggaacaagaaggtaaactgggcaaggtagccccagctaagatcttccggacagtcaaggttacaccaaaagaaggtacatttgatgttcgtgactttgacgatgttgaccttacaagtgctgaccaggctgcaacagaaattgaaggggccatgtgtgatatctatcgaggctaaagtatggcttatgataatgatgatatattacagatttctggaattcagcactttatcttttgtaggcgtcagtgggcccttgcatatttagagaatagttgggtggaaaattacctcacattgaccggagatgagcttcacaaaaaagtagataatccgttcatcaaagagagtcgtaatgccaaatttattgaaagagcaatgcggattaactctcggcgactagggttatctgggatttgtgatgtcgttgaattcattgaaaacccagatggggtgagaatatttggtaaatcgggtgagtatcttcccatcccggtggaatataaaagaggcaaacagaagagtgaccattctgatgagctacaattactagcagaggcggtttgtcttgaagaaatgctttactgtcatcttgattacggttacctctactatggacaaaccaagcaccgagaaagagttgaattttcaaaagaacttagagatgaacttaacaaagctgtagccgagatgcaccgttactgggagaaaaaatatactccacgcgtaaaaactagcaaaaaatgccgatcttgttcactaaaagatatttgcttacctgagctcctaaagacagagaaggtatcggactacattaaacggaggcttgaaggatgaggcaactgttgaacaccctgtatgttaatactcccaatgcctacttagccagtgaaggtaacaatgtcaaaattatcattgatcaagactgtgttggacaactacccctgcagaactttgaatcaatcgtcacctttggttatgcaggggcaagtagtgggttaatgcaaaaatgcctcaaccaagggatagctttgtcttttatgcaaccaaatggacaaattaaggggagagttagtggtaaaccaaccggaaatgtctacctaagacgaacgcagtttagagtagcagatgacgatcaagccaaacttaaacttgctaggaattttattttagggaaagtttttaatcaacggtgggtgatcgaacgatttattcgtgatcacggaatgcaggttgatcaagcaaagcttaaagccgtttcggtaactcttaaagatggactagacaaaattcaaagggcagttgatatggagagccttcgaggaattgaaggtaatttggcaactgagtattttagcgtgattaatgacttgatcattaatcagacagaagcattcagctttcatgatcggagtaggcgacctcctttagatagagtgaatgctcttatgtcttttgcttattcacttttagcaaatgaatgtggtggagcattaattgttaatggattagatccttatgttggcttcatgcatgttgatcgtcctggcagggaaggattagcacttgacttgatggaagagttacgggctgtaattgcggatcgattcgttcttaggatgatcaatttaaaaattttgaggagctcggactttaagcaggctccagatggcgccgttcttcttacagatgaagctaggaagaaatttctgaccaagtggcatgaaaatgagcagaagacattgcaacacccttatctaaacgagaagatcgagtggggattagtaccattcgcccaatcacaattattagctcgttacttacgaggcgatttggatgaatatccaccttttctctggaagtaggtgctttaaatgttggtaattgttagttatgatgtaaatacagaagacccagctgggagaagacgattgcgtcacgtggcaaagatttgtaaggattacggtcaacggattcaaaagtcagtatttgaatgtaatgttgattccactaagcttactgtcttaaagcaacgtcttctagcggaatatgatgaagatacagatagcctatgtttctttaatctaggtaacaaatatcagaataaggtaagccactatggttctaattcggtggtaaacttagatgaaccggtaatattctagtattatcagtagtgcgaacctaaagtgaacataaattctttaaggattcgcaccagaattttggtgattttattcaaaaatcacactaacagttggtttttcagctgtttgacacccaatatgtagaagatggagttctctatttgctatatgttgcggtcgcactccttcgcgggggtgcgtggattgaaatatttgaacaatcatggaaccggcgatattgagctcgtcgcactccttcgcgggggtgcgtggattgaaataattgggtgtgcaaggatcttatccacgtcttcggtcgcactccttcgcgggggtgcgtggattgaaataagaccaattggacaaggccaacgctaagattaaaggtcgcactccttcgcgggggtgcgtggattgaaatcaatcgtcattgaaccaggccgccgttattgccggtcgcactccttcgcgggggtgcgtggattgaaatactgaaccaccgaccgcgtcttccaaatcgtcggtgtcgcactccttcgcgggggtgcgtggattgaaattctcgttttgaggtgataataccaaactcaaaagtcgcactccttcgcgggggtgcgtggattgaaattttcgatttgtgcgataattgcgtcatgttctgcgagtcgcactccttcgcgggggtgcgtggattgaaatatcgttcgtcctcctactgtgccttgtcgtccagtcgcactccttcgcgggggtgcgtggattgaaatatatgatggtaccgtcttgaattctttaaccggtgtcgcactccttcgcgggggtgcgtggattgaaatgtccaacgtagatgacgttaggatttgccagcccggtcgcactccttcgcgggggtgcgtggattgaaatttagattggcgagatgatccagtaatcacgcctggtcgcactccttcgcgggggtgcgtggattgaaatatcgaataaagtccaacgttagcatagccaagtggtcgcactccttcgcgggggtgcgtggattgaaatgtatagctgttgttaacatgatcaccaatcgccagagtcgcactccttcgcgggggtgcgtggattgaaataaatagtcaactacgagtttgttgttgcttcccaggtcgcactccttcgcgggggtgcgtggattgaaataatcagtatgctccggagatccggaatagcgtggtcgcactccttcgcgggggtgcgtggattgaaatacccttagaattggcgtctaatagcttctctgcggcgtcgcactccttcgcgggggtgcgtggattgaaatatacggtacaaattgatccatatcggccatcgccgtcgcactccttcgcgggggtgcgtggattgaaatatattcctgataacggttgtgtgaaatataccctgtcgcactccttcgcgggggtgcgtggattgaaatattgtgccaccatttacattatctggtatctcttcgtcgcactccttcgcgggggtgcgtggattgaaataaagattggcaaccagaaaaacaacccgaccagcgtcgcactccttcgcgggggtgcgtggattgaaataccgtgactttgagcgagttgtaagccacacttggtcgcactccttcgcgggggtgcgtggattgaaatataaggacacgtcctgcacactcccctctgtgggtgtcgcactccttcgcgggggtgcgtggattgaaatttgatattggtggcccgtcgatggtccgttcggccgcgtcgcactccttcgcgggggtgcgtgaattgaaatgcctcgatcttgttcgctctgatcgatatctgggcagtcgcactccttcgcgggggtgcgtggattgaaatggctaaccattgatcggcttgttcttcgtcaagacgtcgcactccttcgcgggggtgcgtggattgaaatatatatattcgtggtactatatagctgtagcaaggtcgcactccttcgcgggggtgcgtggattgaaatataaaagctcggaaccgtgcgccattggttgaagtcgcactccttcgcgggggtgcgtggattgaaataactaccatccccgtgattaccgggacacggtgcgtcgcactccttcgcgggggtgcgtggattgaaatagactagctaaggcgctggtggacgtgccataggtcgcactccttcgcgggggtgcgtggattgaaatgcttggaataccaattaaagattataaaggcaagtcgcactccttcgcgggggtgcgtggattgaaatatataaattaatctctggcggtaacgcactaccgtcgcactccttcgcgggggtgcgtggattgaaatgcctccgctacaccgctgtcaaacatcgccttagtcgcactccttcgcgggggtgcgtggattgaaatgctgcattgacacaagaataaggagagataaacaagtcgcactccttcgcgggggtgcgtggattgaaattgcagggaagcgggcatcgtctcttcaactgacgtcgcactccttcgcgggggtgcgtggattgaaattaagtgcacctccaatgtattcaattgccttaccacgtcgcactccttcgcgggggtgcgtggattgaaataatctagaccatgtgtacctagtagggtcagaagaagtcgcactccttcgcgaatgtggctattgatgatctgtgaggagtttgccaaacaagattcccgggttcgcctaattgttcagagaaatggtggggcggccgcagcaagaaacacggggatcttaaacgctaagggagaatatcttacctttgttgacagcgacgattgtttagatgctgactaccttcaagtcctttatgatgcgatggttgaaaatgaagctgatatgtcgatggttaattacagattatttgagcccacggaaagaggagttaagtttgtaaattatataacggcagatgacgttgaaacgatggtcttagatcctcgaaaagcggttagtttagagagtggctggcacctgaatggatctgtctttatgatgatctgggggaagttgttcaaaaaagagtgcctagagggctttacttttcctgaagggatgatgtatgaggatgaagcggcaacccaccggatgattttacgatctcacaaagtagcttttgtaaacgatcctcactattcttaccgtctccgaagtggaagtgtttcaagagacattattgatgataaaaatctacaggatcttgttcgtgcttacaaaatgaagattgcagattttaccacggcagggatcccaactaaaaatgttcggggacgctatttagctgcaattaaagaaaaacttgaacaaacccgtgatcaaggcccccaatttccaggctaccgcgaatgccaagaggtgctccgtttggcggacttgaatcaataacaaagaaaatgcttacaattcagtattgaaaaagcctggcgcccctcctatcatgaaggtatttgacgagaggggacggacccaaattgaataccttactaaacaacatctcgattcccggcttttttgatgctaagctagcctttgattcgctgcccaccattttgagtggcctaccgatgtcgttgtttttgctggtggtctgctttgccttggccaacgtgctcgggattttgatcatgttaatgcgaacctcttcgcaccgcttcttgtcctggccggcccgcttttacatttcctttttgcgggggatcccgatgctggtgattttatttatcacctactttggcttcaacatggcggccctgccggcggcgattttatccttcacgattgcgccagccgcctttatcgccgagtactaccggtccgccttcttgggggtcgacgaggggcaatttgaggctgcccgttcgctggggttgccctaccacaacatcatcttaaacgtgatcttgccccaggccttccggatcgccctgccgtcactgggcaacgtgatgctcgacctctttaagggtacttcactagcggccatgatcaccgtgtcagaaatgtttatggaggctaaggtggtggccggggccgcccaggattacatgtcgatttacatcgtcgtcgccgtgatttactggctggtttgttgcctcctctcctttggtcagagcttcttagaggggcacttagccacctggtcgaaggaaaaagctggctagtaaattatgtgcaaactgacacagttgaccagattgtcattgattgaaaaaagtacgaattcgattaacccgttataagcccggtttggcgccttttgcgtcccgggcttttcttattttttgttattttgtgaatttcgccttgtgaaaccgctttaccggtgctatcttgtgattagcaattatttaaagtaatctacacgaggttaaaaaatgaactctaagttaaagaaattaatcggtttgagtttagttgccctggtcggggtcggcctgaccgcctgcggtaagagccaggatcaaaaggttgccgaccaaaagacctggacggtggccacgtcgggaaccttgtacccaacttcctaccacgaccccaaaaccaagaagttgaccggttacgacatcgaggtcatccgtgccgttgccaaggggctccacaagaaggtggtctttaaggaatacaacgttgatggtcaattaaccgccgtcaagaccggcaaggcccaaatggcggttaacgactttgccatctccccggaacgcaaaaaccagttcctaatgtcttcgccgatcaagcacagctttaactcgctgttggtccgtaaagacgatcaatccgggatccactcctgggccgacatcaaggggaaaaaggcggctggggaagccgggactaactaccaacgcctggcccaacaattaggggcgaagttggttaattacgacaacgtctccaacgacgtctacttaaagggcgtccaaagcggcaagaccgacttgatcatgaacgactactacctgcaaaagctagccttagccgcctacccgaactccgggctggaaatcgatccggacatgtacttcgtgaccaacgaagacggtaagggtgaagggattgtcatcaataaaaaggacaaggccctccaaaaggaagttaacgaggagctagccaagttaaagaaggacggcaccctgaccaagttggccaagaagttctacggcgccgacgttaccaagaagccaaacgtcaagaacctcaagtacttcaagatctcaagcaagtacaagggcgaataataggggagcgggcactacgtttcccagctaacattcaaaatatcttaggggttaggagaggtctcttagcccctttttgtttgtaaaattagggttgctgtgataacacgattaataaagaagggcgccacgattttaactatcaaaaagttagcgaaagtaattgcttatctttagttagtggtgtaaagtaaatgtatcaaaaaatgtaacatcaaaagggagattgacacatgaaggaagaattactgaatttagctaagcaacgccgctccatttacgccctgggcaagcaggtggaccaagacaacaacgaaattgccactttgatcaaggaaacgatgaaggccgtaccgtccgccttcaactcccaaactacccgcgccgtgattgcctttggtgatggtcacgaccaagtgtgggaaatcgtgcgtgccgccctgcggaaggtagttgaaaatgacgatgcctttgccaagacgagcgctaagattgactccttcaaggccgcttacgggaccgtgctttacttcaccgacatggacatcgtgcacaacttagaggaacaattcccgtcctacgctgacaacttctacgactggtccgaacaagccatcgggaacgccaacttcgccgtctggacggccctagccgaaaacggccttggcgctagcctccaacactacaacccgctgatcgacgacgccattcgcgaagcctttggtgttccagcttcctggcgtctgcgggccgaaatgccgttcggttcgatcgaagccccagccggcgaaaaggaattcatggacgacgcaggccgctttaaggttgtcgactaatcacaacaaaattaggctcccatttcccgggaaatagctacgggaaggggagccttttttggtgcgctgacaaattgttaaaatacttttgaaaatctactgacatccccggagaatccacccgtggccgggtgaatttggtataatagacctgcttaatgttccgttttcaacaagcgctgcaaagcttggttggccaaggaatgggcgccgtgattttgactctcggacacccactgggtgaccacggttggcagggcgtcgatccgctcaagcaattgatccagttcgggttggtaatgcttggcgtagcccttaccgattgcgtcggccaagaggcggctatcggtgtaaaacatcaccacttggtcgtgacagtagttggctaacaggtcgtcaaaggcggccgtggcggcagcaaattcaccgtggtggttatcggcctcagctagggtggcggattgctggcgctgcttgccaccggcgacaattagccagcccagtccagtgggccccggattacccttggtggcggcgtcggaatataatttaatcataaactacctcacatgaaagaagagaagactttggaagaacaaaaacgctacttttaccagcaggacccgaccacggcggtgatttcgtggtcatggaccttcattattttaatcatcggcgtggtgatctggctagaaattacccactttcagtggatcacggcggcctttttggtggcctttttcgcggtggcggccctggccgttttccgccgaacgatgacggtcaaaaaagacgagatcgtcttcaaccggatcctgcaaaaggagtacatggtggtgccgcttgacgagattcgccagccccgctttacccgccacaccctgtcgatcacggttcgcggcgaggtgatgaccttcacctttagccaccgctcgatcacttcgcttagggccatcttaaccgatgcgaccgcccaggggcaaatggaaagcgaggaagcttagtggcttactatcttttgttcatcgtttccttggttggtctggaccagttcgttaagtactgggtcagcgctaacatcgccctggggaccagccacggctttattcccggcctaatgaatttaaccaacctgcacaacgacggggcggcctggagcattttagaggggcagcagtggttcttttacctgattaccttagcggccgtagtggtgctggcttacctgatgaggcaatggcgcaccaaccggtggaaaatgatcgccctgtccttgatcatggccggtgcgcttgggaacttcatcgatcgggtccaccagcattacgtggtcgacatgtttgaactactaccgatcaactttccggtctttaacgtcgccgattcgtgcttgaccgtcggggtgatcgctttaatcatcatcattttaaaggaggactaacgtggaccaaacaacgcaaactttaaccgtcacggacgggatgaccgggcggatcgacaaggaattaggtcaccactttccccagttctcccgctcccagctcaagcgctggatcgatgatggcaccgtgaccgttaacggccaaaccgtcaaagccaagtaccaactccaagcgggggatcgggtggtgattgaaccggaaacgccggtcgaaattgacctggagccggaaaacatccccctcgacattgtttacgaagacgatgacgtcctcgtcgtcaataagccccaggggatggtggtgcacccggcccccggccaccccaaccacacgctggtcaacgccctgatgtactacgcccccttgtcgtcgatcaacggcgagttgcggcccggcatcgttcaccggattgataaggatacttccgggctcttgatggttgccaagaccgaccgggctcaccgcagcctgaccgcccagctcaaggaaaagagtaacctgcgcgagtacgttgccctggtccacggggtgatcaaggaaaacgaggggacgattgacgccccgctggcccgctcgcccaaggaccgtaagaagcaggcggtggtggttggcgggcgccacgccgttacccactttcgggtcctcaagcgctaccagcactacaccctggtggcctgccggctcgaaaccgggcggacccaccaaattcgggtgcacatgaaatacatcaaccacccgttggccggcgaccccctgtacgggccccgcaagaccttgccgggccacggtcagtacctgcacgcccgcttactgggctttgagcacccggtcacgggcgaggaaatggttttcacggcccccttaccggattactttgaacaaatgttaagttgcttagatcgcacggacgcatagtcaaatgatgagatgagggagggatcctgatggtaaagcggtatttaatcctggaggacgggacggtgtttgagggagaggggtttggcgccccggccattacctttggcgaggtggtctttaacaccgcgatgacggggtaccaagaaatcatcaccaacccgatctaccacaaccagatcgtgatcttcacccagcccaacgtcggcaattccctgatccactccaacgtctatgaatcgatcgaaccgccgatcaagggggtgatcgtccgcgacctagctaacatcaccgcacaaaagggccgtcaccggatgaccttagatcagtacctcaatttgatcaacgtgcccggaatcaccaacgtcgatacccgggccttgatccgtaagttgcgcgagattgggggcgccgtccgggggtcgatcgtgccggtccccgacgcccacgccttcgaccaactgcacgccaccgtgttgacgagccaacaagtggcccaggtggccacccccaagccctaccccaacccgggggtcggccgttccatcgtggtggtcgactttggccttaaaaacgggatcctgcgcgaactgtcgcgacgcaagtgtaacatcaccgtgctgccctacacggcgacggtcgatcagatcatgcggctcgatccggacggggtcgtcttgtcgtctgggccgggcgacccgcacagcttgaaaaaatcggtgctcaagatgatccaagagctccaggaacgggtgccgctgtttgggattggcctgggccacgaactatttgcgatggccaacggggttcaagtggaccgggtaccggtggaaattcacggcatgaaccacccgatcaaagaaatcatcaccgaccacgtggtctacgctaaccagggggccggctttcaaattcagcgcgagtcggtcaatcgcgagaacctgtttgtgacctacgtggacatgctgacgggggcagtccagggcctgcgccaccggcgttacccggccttttcggtccagtttttcccggacgggtcaccaggccccgatgaaaccgacccgctctttgatgaattcatggaaatgacgcggggtacagaggaggattaagatgacggcagtattaatcattggtgcgggggccgacgacttacaacatggtagcgagctggatcaagccaccgtggaagtcgccagtgccctcaaaaagcacggcttagaaacgatcctcttaagcgacaaccccttttcttacgccctcgatgacgaccgggtgattgaccacccggtggtggcgccgttaggggttaaacaggtggtcgacttgatcaaccggtttgagccgaccatgatcatcccgaccctggggagtcgccactccttggagttggtgcaggcggtcagcgaaacggggatttttcaggaacgcgggatccattactgcggggtgcccgaggcaacagttcgccaggtcaacaacccggtcctcttatcccagaccctcaaacagctgggggcctcaaccaagctgatccggacggtgagcgattttcagggcgccgccgatttagtcgcccaggttggttacccggtgatcgtacgggcggccctacctaaaaagcaggcgccgcgccggattgtccacgacagccgggagttgcaaaacgccgtggccgacgggatccaggagtcacgagcgggccaagtgatggtccaacaatccctggccggcttaaaggaaattgaggtcctggtgatgcgcgatagttcggggacgatgatgaacctggcgatggtggaaaacctggacccgattgggattcacgccggcgattccgtcgccgtgaccccggcccaaaccttgatggaccgggaaatccaagacattcgcaacgtcgcctttgcgatcacccggcgcctgcgcatcgtcggggtcaaccacgttcagtttgccctcgaccaggagcaccaacgcttttacgtgatcaaaaactcaccttacttcgaccggatcgctagctttgtcgaggtggcgaccgggtacccggtggcgaccgtttgcggccacctgtacgccggccagttgttacggaacatcaagttagggcccaactactcgcgccacttggccctgaccgaaccggtgatggaccggacggcggttcgccttccgaccttcccgattgaaagcctgccggggcagcgctgggagttgcagacggaaaagcagtcggttggttcggtgatcgggatcggccgttcctttttagaggcgattattaagggtgccgccgcttattacacaccgaccaacgagcaaatcatcaaagcaattgccaccttctccgatgaccgcttggatgagcggctaattcacccccggccgcaccgtttactgaccctgttagaagccctcgcgcgcgggtattcctcggatgaattgaccgagttgaccaagatcgaccgctactacttcgaccagctcaagcgggggaccgacctggtccggcgcctaaacgaaaaccagggttcactggacatccttcgggaggccaagtactgggggctgtccgacgaccaaattgcccagtcctgggcgatcagcccgcaaaaggtggcggacctgcgcgaagaaaaccagctccaccgcgtttataaggaggtggacccctcggcgggggaatttgatgagcacccccaccgcttttacgccacctttgaaaccgaaaacgagagcgacgccaccgccggcccccgggccctgatcgttggcgatgggccccgcaagctggggaacagtaccgctaacgattacgtgttggcgatgattgcccgcgaactaaagcaccaccagtaccaggtggttagccactccaataaccccaattcgttgttaatgacccagtggttgagcgacaaggtttacctcgagccgatgaccgaagaggcggtcgcttcggtcgcccggctcgagcggcctgactacgcctttgtccccgccggtaaacaggagctggggcgggcaattgagcgggtcagccccacgacgaaggtggtggtgattgaagccacccagatccccaaaaacgtggtttcctcaatcccaaccctcgagtttaacggcctctttgacggccaggtagtctaccaactgggggttactggcgaactgaaggaccagggagttggtaagtatcaaaccctggccaagcgttacccggcccacttagagtcggacctggccaccaaggtgacggccaccagtgaacgggcgattagccaacaggaaacgcccggtttgtatcaggtcctctaccaagtcgatggggacgccgagggggtccacgaagacgtctcacccctgacggccccagacatcgcctttatgaccaaggtcttgggaatgaacctgactgccatttgggtccgcttaatgattgggcgcttctctggccaggccttggtcaaggctagtcacgagggaaccacctaccacgacgccatctaccgggcccacttcccctacgccgattaccacttaaccaaccaaaagtcggcgccggccaccgtgatcggggcgcagattgaacgcgccaacaaagggagtgaacaataaccctctcgcacacattaccaaaccaaaaggggtcgggaaaaactctgtttttcccgaccccttgttgtattcacgagggttagacagaaaacgtggtaaataaccgcaggtctagtgtctaagcaggccgaagaacggtgcgttccgcaccaaccgttcgtcctagcttagtcatacgatctgccgagaaggttattttccactctcgtagtaatggtaaaccgggaccgtgatgggttgtggtgcccggtagttgtcggcaaacaagtcgtgaattagtgccagtgaaccggaagaaaaggggtgcacggcgtcaagcaccacccaagtcacgtccggagacagtggtggggtcgtcaaagaaccggtgtaattaaagtagccctggttgttagcaaagaactggtttaagtaggcggcaccggcctgaccgttaatgacgggagcgaagtcaaagccggcttcaccatcggcggcccttatccccagcatggctaagaccagggtttgcccctggtcgtcttggtagacaaagtggacctcggcgtcttgccgctggccatcaaacaggtgctcgctgtggtcgtggaagtggaggcgcaagaagtggtagtggtggttccctagcgttaaagtgccagcgccgataaactggtccccagacgaacgggggtcgcgggtcagtgcctggtcgccgacaaaggagacggttaagggctggtcggcgagggggcgtggggtagtttgctctaaaacgatgtcgatgggtgactgttggctagcgggaccttgccactggtcctgggtctggtaattgatgtattccatgaaaagacacctccaaataattaaccttattatagcgggttatacaatcgctttctagggaattggggagggcgaaagaaaattaacgagagtgtcaagaatgttgtgtaaaaaaggaaacttcgcccgcatgaattggcaattctaaaacatcgaatcaagcgtgtcgtgacagtccttgaatccccgatgtgctcgattctcaaatttatcgttgtactccatcacttgcgtcatgataaagcgatcgagggccccttcgtttgggaactgctctttacgtcggaccatcttcttcaggctcttattgaacgactcaattaggttcgtcgagtagatggtctgacggatcgcagttggaaaactgaagaacgtgaatagctcctccatttggactagatacccgtcagttttcgaaaaaatacgaaaactgacgggatttttatgaactatgaataattcaggtgtatataaaaactgctaactctacctattgttaggtaaaattagcagttttagttagtgtttaattaattggttcaattttttagcccaacttgctcttcacgaagtcttgaacttcttcaacagtggcgcagttggcgatgatttcgtcaacgtagccggcccattccttggtgtcgagcttcttcatcatgctccgggtacggaggatggaagtagcggacatggagtattcatccaggcccatccccatcaagagtggcagtgccatttcgtcaccggccatttccccacacatggcggccttagcgccgttttcgtgagcggaggtgatgacgtgcttaactagggataagaaggctgggttcagcggttggtaaaggtaggaaacggcttcgttcccacggtcagcggcgaagctgtattggatcaaatcgttggtcccaatggagaagaagtcaacttccttagccagttgagcggcgtttaaagcggccagcgggatttcaatcatcatcccgatcttaacgtcgtcgcccagacctgggtgatccttttgaacttcagccttggcttcttcaaagatcgccttggcttgacgaagttcggccaccgtcgcgatcattgggaacatgattgaaacaggtccgaattcagaggcgcgcaccagggcccgtaattgggtcttgaagagttctggccggtccaagcagatccggatggcccggtagcccaagaatgggttttcttcctttggcagtggcatgtaatcgagcggcttgtccccaccgatgtccatcgtccgaaccacgactggcttaccattcatgcccactacggccttcttgtaagcttcaaactgttcgtcttcgcttggcatgtggtcgttgtccatgtacaagaattcgctccggaagagacccaccccgtcagcaccttgcttaacggcgtcttccgtgtcatccggcgtcccgatgttggccgcaatttcaaattccttgccgtccttagaaacggatggggcatcgactaacttagcccattctgcccgttcggcttcgaaggcttcggccttagcttcgtattccttcacttggtcgtcactcgggtcaatgatggcgtccccgttcaaaccatccacgatcatcatttgaccgtgttcaacggaagtcgtgatttcgttagaaccaacgatggctggaatccgtaaggtccgggacatgatggcggcgtggctcgtccggccccccaggtcggttacgatccccttgacgaacttagcgtccatctgagaagtatcggacggggtaatttcgtgggccacgatcaccaccgggctgttgatgccggcgatgtttagtaattgcttacccaacaggtggctcattgcccgctttgcaacgtccttaacgtcggcagcccgttcttgcatgtaggcgttgtcggtcatggcggccaacatgtcagcaaaggcggtcgttaccttgtcaacggcttcttcggcaccggtgtggttgttttcgatgttatccttaatttggcccagcatttccgggtcagataagatggcgatgtgagcgtcaaacacgcccagctcttcttccccaaggcgatccttagcgttctccttgatttgcgtcaattcttcaattgagtcttggaaggcttttttaacccgagcgtattccgccgccgtgtcatcaacctttaccttgtcgtaggacagatctgggtcaaccaacaggtatgccggggcaatcccgatcccatcactagctgcaattcccttcatgtcttttgccattatatgttcctcctaaatctgggtgtcaaccgtgtgacactgctcaatacgtctaattataaaccgttatcattgtgaattctaccgtatattaagcggttgcatgtaaccggttcaacacgttgttatcctataaaaaacaggctgattctgcaagagaatcaccctgttttttgtaaatttataattaagccttttgagcttccttcttagcgatcttgtgttcagaaaggaagaaccacaggatcagggcaaaaccaattgccggaacgatgaaggagaattgcatggaaccagtcaggtcagaaacacgacccatgataaccggaagggctgccccaccaacgagggacataaccatcagggcaccaccagtttcggtgtgttgcttttcttcgatctggtccaacccgtgagcgtaaaccgttgggtaaactgggccgaagaagaaactagtcgcaacggcaccccagattgccaatggtgagtgaattgagcaagtcagcagaagaacaatcgtccctaatacacagtaccaaatcatcgtcttggtaatggagtaacggttcatgaaccagttggcaaagagcttcccaacaaaccataccatgtagctaatgatcatgtagttagttgcggcatggtcagaaatccccggaacaatccgcagtgccaaacgaatggtgaaggaccatacacaggtctggatcccaacgtaaaggaattgggccccaaccgccttcatgaagcgccagttgtggaacaggtagtttaaggattcacccatacttggttggttagcagtcttagcgtccgccttcgccttcccgtatggcatcttcgtaattgctaccaatactaacaggatcaacagaacaaacaagatgtacttgtacggacgaagcgtcagggcaaggacttccttgtttagtgccatcttttgtgcagcgttcaaaccagcagactcattttgcaagttactgtgaccgctaaagatcaggtacttccctaagatgatccccatggcatccccgaacggaatcaaagtttgggagatgttaatccgccggttggcaaactcacgcggccccatcatcgttgagtaagtgtcacaagaagtttccaaaaaactcaaaccaatggcgataacgaagatggccgctaagaacatcccgtaggttgccatgtgagaagccgggaagaacagcgcacaaccaataatgaagaatgtcaaaccggtcataatagctgtcttgtacgtgttcttccgaataatgtatgacgcaggaagggcgatcaagaagtacccaccgtaaaaggccgattgaacgaaggcagttgccgtatcgctcaacgtaaagaccgtcttgaactgcgtgatcaaaatatcgttaagtgacgctgccatcccccacattgggaagatcaacgaaactaaaatgtattgccaaaccggcgtcttgctgaggtagccgtcgtcatattgaacccacgactgcttctttaagttatccatgtccttactcctccttagaaggttaccccggactcaagaatgatgtttgagtacggcgtcatctcacccgtccgaataaatgcatgcgtcttagctaagttcttcttcaaatccgtgtgtggcataaactcaatttcaacatctggcagtgcctgcttgatgttttctaattgttctgggttttggtccttaatttcatctgctaagtagatcttttgaaccttcatttccttcagaacgttttccaagatttgcatgaacgtaggcaattccttgtctacgcacaggtcaatcttcttcgtccccatcggaactggcatcccggcatcaccaattgataaccagtccatgtgtcccatgccagcaacgacagatgctacttctgaatttaaaattccactcttcttcatgactaataacctccaaaacgactctacttcaatgcttcttgaacttggtcaaacgttgggattgatggcattgcccccatcccttgaaccgtcaaactcgatgcgcgctgagcgtaggtaatggcgtctgccaagttcgagaagtccggtaacaattgtgaaattaacgccccaataaaagtatcccctgctgcggtagtatcaattgcctttaccttgaaggctggtaccgttccggaaccatccttagttgagtagtaggccccctttgaacctagggttactagggttacgccaacacctttggcacagaagtactcagcagtttgatccagtgatgcatcatccgtgatctcaatcccagtcagcaaagcactttccgtttcgttaggagcaatgatgtccgtgtattccagcaactccggcaggatttccgttgccggtgctggattcaaaactgtaataacaccatttgccttcgccatcttaaatgcttctaaggcaacagtctgtggtgtttcaaattgggtgatcaaaaagtcgaccttcttcatcacttcctcgctcttactaagaacgtccttagtcatcgcttggttagccccaccataaaccatgatgtcattttggccattttcatctaaagtaactagcgcagtccccgtaccgtggcgcgggtcattccccacgttcgtcgtgtcaatgtgatcttcttgtaaggcatcacgcatgaacttcccttcggagtctgcgccaaccattccaatgaagtacgtctctgacccagaacggactgcagcgactgcttggttcgctcccttaccaccaggcgctgaactcttatccgttgcagctagcgtttcaccaggttctgggaaacggtgaacgtgataagtcgtatcaacattgatgcttccaagaacagcaactttgtttgacatataatttcctcctgttacaacgcatccacgtaaaacgttttgttaaaaccttttacgtaccaatcgacccgtttagtttatcatctcaagaaagcggttgcaacaaaaaatagcgtcttcaaaatcctgattatcactcgttatgcaagcgtttgctaaataatttattcacaaatacctatcattacaacaatcaaaataaaaaaagaattttagcaaaagcactaaaattctttttaattttttacatctctatgagttgttttgcatcttctaaatcggtaattaactcgcttgcgtacccaccaactaaggcggcgtgaagtgctgctagcttcgtactcccgcccgccacgaggattgaatggcgtttcaattttaactgctcaatgggcagcgccattgtttgcttcgataattgcggatcagccacttggcctttacgatcaataaattgggaaattgcatcaccaaccgcatgttgctttaaataggcaatctgctccgcagttaaataccccaattgaaacagcattgcatcatccatcgttgttccaaccgtaaagagggcaatctcagcagtagccgctgtttccatgatttggtgaataaaccggtcccttaaaacagcatcccgggtctcttggttatcaaagatgacaggaaccggaagaattaaggtttgggtgctaaaagcttggttgaatttttcggcaatgtagctggcgtagttatttcgcgatgaatttgcgaccgtccccttcagatataccgtttgaacatcttttttattacttggttgcaagtaatctgccacggcagccattgtcctcccccaacttaacccaattgtgtcaccatcttggacaatttcttggaggtagtttgccgttgcttgccccagttgttcaagaatctggggatatgattcacccacttggtcaacaacaatcgcccttttcaaaccgtacttggttcgtaaatcctgctctaaactaccaacgttttcaaaagggtcctggattcgaatatcaaccattcccatatcaacggcatactgtaagtacctagaaaccgttggtcgggagatttctaaattttttgcaatatcagtttgactaactttatctagatagtaagagctagcaatccgtagtgccagcttaagttgtgtttccgttaatttttcacttcgcatcaccattcaaccctccttgtcgttttcatatttccattttaattatttacaattgaaaaaacaataaatataatgaaagcgtattcaaataaaaagggagctagaaataatggaatttaataactacattgaccacacccttctcgccccagaggcaactgaagagcaaattgaacgcatcgtcaaagaggcgatggacaataactttcacacggtaatgattaacccctactgggttgaaaaagtccacctacttctgaagggttcttctgtcaaaacggcttgtgtaattggatttcccctcggggccaacaccaccaaaatcaaggttgctgaagctacagatgccattgagaatggtgctgatgagttggacatggtcatgaacatcggcgaaatgaaatctggtcacttggataaagtggagcaggatatccaagcagtcgttgatgtctgccaccaaaataagcgtgttattaaggtcatcatcgaaacttgtctcctaactgatgacgaaattgaagcggccgctaagatcgttgctaagacgggggctgactttgttaaaacctcgactggtttctccacccaaggcgccaccgtccacgctgtcgagattatggtccaagcggtcaaggggacttccacggccgttaaagcctctggcggtatccacacccctgaggacgcccaagcaatgattgatgcgggtgctacccgtttaggagtcagtcacagtcttgccatcatcggcaaagcataggaggagtcgtaacatgaagaaatttaacctgagccatgaaatgttttccgccgctacgtttgacctttacgaagacgacaactttagggtatcaaccttcaagtacccctctggtgttgaagctctgaaggtgtccaacagccggggttacctcactctcttaccgttctatggtttgatggtttgggacgctgtttttgatggcatcaccttgaaggaaaaagatggtttcagtcagccacttttcggtaagcagatctctgacacttacggtgcctttgaatttacctccggcttactggcaaacgggaaccccagccccgaggataaccacgttcaacacggggagtttgcaacggcacgcatggatcacgcagcactagttgttgatgatgataccatcactgttactagcgattacgagtacatcaagggttttggtgaccactacctagccaccccatcagttacgatgcgcaaggacagcggcctctttgatattgagcagcacgtcaagaacctgtctaactgtgccccaatgaccttgcaatacatgtgtcacctttgctacgcctacgttgataacgcaacaatgacgtccaacattcctgatgaagccttccagctacggacctccgtcccggcccacgttcacccaactccagaatggatggccttcactaaggaattagaggagagtggcaagttaattgacaagctcgatgacccaagtcactacgatccagaaatcgtcttcttctcctccgacttaactaaatacactgacaccgcagaattccgggttgaccttggaaatggtcataacttcttaaccacttacaagaccgccgagctaccaatcgttacccgttggattctttataacggtgatcaacaagtcaacgcttttgccctaccaggaacttgcaccccggaaggccaattagccgctaaaaacgccggcactcttatcacactcaagccgcaagaagaacgtcacttccacgttgttactggtttagaaaactaaccacctcgcttgttttaaaaaggagtgaagaacatgacccacgatattactgtaattggctccaacatgatggaattaacgaccgatattgaccgcatgcctaagttaggggaaactgttagcgccccaagttttcacatggcctttgggggaaagggggctaaccaagcttacgccgccgctcaactaggctcctcagtggccatgatttcaaaggtgggctccgacagtcttggtcaagcctacttggaacacttccaacagagcggcattgacattacgggcgttagcgtcggtaaccaaagtaatggagtggcgccatgcttcatccaaggcaatatgaacagtatcatcgtggttcaaggggctaacagtgagttaacgccagacgttcttgatcaatacaccgatctcatcaaaagctccaaaatggttatcttgcaacaagagatttcgctggcaacggactaccgagccattgacctagctgaacaattccatgttccggtgatgctaaacccagctcccgcgaatgataacgttgacttagaacacatcaccaagtgcgagttttactctccaaacgaaacggaactcggtcgtctcacccacctgccggtagaatctatcgaccaaattaaagacgctgcccattcccttgttgaccaaggggttaaaaacgtaatcgtcacaatcggaagtcgaggagcactctgggtttgtgcggatcatgaagagctcatcccctcttacaaagtcaatgccgttgactccatcggggctggcgactcattcgtgggggcctttgcccactactacacgaatggtgaagacatcccaactgctttaaggcacgccaacgcctacgccgccgttaccgtaacgatgtccggaagccaaacctcgtacccatccgcagccgaattacctcagctacaagagcaactgggcatcaccgtcgacccgactcaacttgcttaactgaaacaaaagaccagtggttcaaatctgcgaaccactggtctttttgtgtcataatcttattttgcattcttttccgccatccggttcaaataagaccaaatttgtggtcgataccggcgaagcccatacaacgctaccaagtagataacgatacacagcccaatccaaaccggattctgggaaataaaggccgcgaatataagggcgtttaccggccgggcaattagattgaagctagtaatcaagactaccccggctggaatcgccaccccatagtgagaaaccgtaccggtgtagatagttcctaaccaactggaggcgtacagccccaatgagaaccaaacaattccgttggcaatcacctttaaaatattgccacgagtaacggcgacgatcgattcaaccatgaagggcaacgatattaaatcaactaccggtagagtccgattccccggtaagatgaaggcgattaccaccataatcggtattagaatcaccccggcaatgattgtagctggctccccgtaaccaaccccatcatcaacaccaaggaaccaccgttttttatcgtgaatagcatcgatttcttttccttgctcagccacttcctttttgcgattcttgtcaatctcttcagccaatggcgcgaaggctttggcaaagactccggtcaccagcgggaaaattgtcattacggcagctagctgcacggcaaactggaggatttgtccccaagctttgatagttcctaaactatggagattccctaggataccgataattaaccctaacaacgcccctaaggtcgtcggttccccaaacacgcctaacttattcttaaagtattccggagtcaccttaaccttgttgaagccgagtaggttccacagtggatccaaaagaattgccgggatggtctgctcaatgttatgcggggccgccaccgtagcgtttttgaccccatagtaatctgaccatcgatctgcctgaacttccgccaacactaaggaatacaggagcataaaaaaggacaaccccatcgacaaccaaaagttgtgggtaacatagtaggccatcgtcccccaaatcatgaaaccaaagttgttccataagttagaggccataaagactttagtgattcccaaggcaaagatcagcaattcaaacagaagcccgaacacaaagaaagccaggcctacagttgacccaaagctagctagagacccggcttgccagccaatgtcgaccaccgggagtttaattccggtagtactcaccatctgcttaataatcttagtgaccaccggtgtgaattctgaaatgatccaaccaaaacccgtcagccccaccccggcgtaaagggcgctcatcattgccattttgggttgaacctttaagaaaagggcgatgataaaaatcatcaccgggacgacaacgctagccccaaacgccgtaaaaaaggcattgacatcttgaaacatattttccaccccatctgctagtgtacattgaaaataaatatataaatccctcgataaatcattagtgctaatgttattctaactctagaagaaagcgtttcccaactaaaagccgttattttaccggataagacgctaactaatttaacattgtcgttgaatacattcctattcaaaacaccccctagagatgacacttttattatttaaagtgtcaaccctaaggggtattgtacgcggaacccgctgggcgcttttctgttactaaaaaggtgccgcaggggcacctttaaaccggtttagttggctagagagcaccaacggcacacggtgtacttctattgatagtcacattatagcaaattttccccaaaaaggttgtgtaacgacaaaatgtgtctacaaggcgcggtatgataaacttacgggtccttggtaaagagctggcgggcgatggcaaagacgcggcgccggagttcgtaaaccgaggggcgggaaatgtgtagttgcttggcgatttcggcgttggaaaattgctggagaaataaggataggtattcttgttgccgcagggagagggcccgcatcaggctggcccactgctggcggttctcgatgttggtcaggtagccagccgcccaggggtcttgcatggctgccaagtgataggcggtggccggcgaggtgtcggtcgagacctggcgctcatcttcttggtgccaactcttctttaagaggtccaaaatccgccaataaatcaacttataagcaaaggcatagaagcggtcgcgttcggcgtcgacactgcctttgaaggcgacgtaggcccgagcgtaagcgatacagccctcctggtaaaaatcatcgtaatggcggtgaaacttgctgacgtggagcttggctaaggccattttgactaagcgctcctgatcgtggcgacagaggtcgattaacccttcacgcatcgttcgttcggtaatcatggtatcaaatccttcgtgattatttctccggccgggataggttaaagataccaaaatgccgccatatagggaattctcctaatttatgaatcattagcgaatttttattgacaggcctgaaaaatttgaatatggttatattcgacggggctgtgaaagcggttccatgaggaaaaattattttgaggaggattttgggaaaaatggcaccactagttgattttcacgatgcaacgacattgctaggcgattttaccatggtcaagagctacacgattgattgggaaaagacggtagtcgtctaccggggtggtcaccatcaaacggtggtggtgactaacgaaggcgacgccctgctggttgatagtccgctaccgaccttgctccagcacttctgccaagatcactgcctgtcgtgggcctggcacgaaccggtcaagcggatcttttatgaccgcttcacccataaggaacggctgtcggaggcctacatcatgggcttaaacaagctgatcccttacaaggacaagaacgcgccggacgctggctacttcatggcccacctgctttgtgactaccaagaactcgccagagaacaggtcatgttgatctttgagggtggggtacgggtgaagattcgcgctagtgccagcgccgtacgtcgccagctcgaccgggccaataagttagcccagattcatttggacgtcttggactttatgaaccgggaggccggcctttacgtcaatgaacgcttgaagaactatgaacggatccgggtgtcgtccgaaaccgcccggactttcaccaagtacgcaatgctggaaagcttcaaggccagccaccaggcggcctttgaccagcagccgaccgcccatgacatcgccgaagtggaacggaaaatgttcaagaagtcgggggcgttgaagaaatgagcaactgataagcagtgattattcggtataatgaataacaggaaataactgtgaacgaagtatgaaggataatgggagtaaagaaatgaagctagacccgatgattaaagagtacccttataataaccaaggcctaaaggagttggaagagggcgagtctagagaagaaagcaagattatttcaaggtacccaactgtctatgttgtaaacgataagaaaaagaagaaaatttattcagtttacgttggtgagaccaataatattgctaaaaggactgctcaacatcttcatgacgatcccaaaagtcgggaagattggcgggagctatcggaatcaaaaacggccaagatgtatgtgatcggccaccagcacttcaataagtcgatgacactcgatattgaaaatcagttgatgctgtacctaagcagtgttgagaacgtaaaggcgctctataatcggcgttcaaatgaccaagatgaatactatccggtgaacgaagtccaagatatctttactcaaatatggacgcaactgcatcagaaaaatagtgaattattcccagcgatggatgtgcttaaagacttagccatctttaaggcttcaccctttcacaaactgacgcatgaacagttagaagccaaaaacctaatcatggaacgggttaattcttctttggataatgacgaggagggccaactcattatggttacgggtgaggccggggctggtaagaccgtattgttgagtaacttattttacgatttggtgggttacaaaaaatacggccatccgctaaacgttcacatcatggttaatcacgatgaacaggttaaggtttatagggaaatttccaagaaattggggatcgatgtaaatctggtgggtaagccaaccagttttataaataagggtgaaaaggccgacgtcatcttagttgatgaggcccacttactatggacccaaggtaagcagtcatatcaggggactaatcaactagaagacctccgtaaattgggcaaagtggttgtgatcatctttgaccaacaccaagtcttacgttcccaacagattgttgaagctgctcaacttcaaaggatggttggtgaagccttaaagtcggataacctgattgaactaaagaatcaattacgaattgacgcaaatgaatcaacaattcaatgggttcgcgacctagttgatcaccaaaaagttgggaaacttcaatcagatagcaagtacgagataaaggtctttgattcgccaaaggatttagagaatgccattcaaatcaagaaccgttctgacttggatagccactacgcaaatggtatttccagactaattgcgacctttgattggactttttcaaccgggagtaaacctgcggatgggagtccaacatgggacgttaaaattggtgactggcgaatgccatggaacaatcaactgaagacaaagcaaaagcgaagcgttagttaccgaaatttatcctgggccgagcgaagtgaaaccattaatgaagttggctcaacgtatacaattcaagggtttgatctaaattatgcgggggtgattatcggtccctccgttaaataccgtgatggtatgatcgtgtttgatcctaaagcgcacgcaaataaggatgcaaaccaaaaacgaaccctgcaaagtggtgagaagcgttcctttgccgaaaaactgatccgaaatgaattgaatgttctactaacccggggagttcacggcttatatatttatgcggtcgaccctgaacttcgtgaagccctaaagaaggcaatgccacattagggacgttttctgttcatcgcggatgatgtttaaagaaaagattgaataattctttgccggcctcggctaaggtacagtaccctgctcctcagcctctattcttttaatcccttccttcaccacataataatgtccgaacggcatcgtaaggtggaatggtgatgtaataccggacctcaaaagtttgtaaaaattttggtgtgttcgtttaatcacaacacaaagtatttcttaacttttaggtgcgcccagtcgcccctgactactagaatttaggtttaatttcaaagggatttgcactttgttaagaagaaagataagtgtttaaatgaacaaagtcaaacagaggggtgaaaactgttcaataaatcacgatgattagcgcgactttagctggtattgccgaattattggtgctaggatctgataagagagacgccaaagtgagcaaattcgaaattcaggcaaagggagaattgaaatgacagaagaaaagaaacgctacggggccgacgcgattgtcgacagcctcgctaatcacgacgttaagtacgtctttggggtgccgggggctaagatcgaccggctctttgaacggttggaccacccggtgaacccgaaggcgccgaagttgatcgtgacccgtcacgaacaaaacgcttcgtttattgccggtgggattggtcgcttgaccggcaagccgggggtggtcttgaccacttctggccctggggtatccaacttggccaccgggctggtaaccgccacggccgaaggggacccggtcttggccatttcagggcaagttccgcgccgcgacttaaagcgcctaacccaccaaagcatggataacgccgccctcttggcaccggtaaccaagtacagcgccgaagtccaagacccgaataacctttccgaagtcttgtccaacgcctaccaagaagctgtcgcaccaaagcagggggcggcctttgtttcggtaccgcaagacgtcaccgacggggaagtcacttccgccccgttagctccgcgcgaagacgtcaagttggggccagccaacttgagtgacgtggaatggttagccaagcaggttaaagacgccaagttaccggtactcttagtcggaatgcgggcttctgatgaagaaaccaccgccgctatccgccagctggtggccgaaacccacctgccggtcgtggaaaccttccaaggggccgggatcatttcccgcgaactggaaagcgacttcttcggccgggtcggcctgttccgtaaccaaccgggggaccgggtcttaaaggaaagcgacctcgtgatcgccgtgggctacgacccgatcgaatacgaaccacgcaactgggatccgaccgcaagcgcgagggtcgtcgtgatcgataccaagcaagcccaactggacaacaacttccaaccagaacgtgaactgatcggcgacatcgcttcaaccttgaccctcttgtcaccacagttgactggttacagcgtgccgaagaactcccgggccttcttggaccaggttcaaatcgaggtcacgacccgcgacgaacccaagccagtcaaggaaggccaagtcctcaaccacccgctcaacatcgtcgcggcgatgcaagaacggattgacgatgacatgaccgtgaccgccgatattggttccttctacatctggttagcccgtcacttccgtagctaccaaccacgccacctgctcttcaccaacgggatgcaaaccctaggggtgggcttaccatgggggattgcggccgccctggttcggccaaattccaaggtcgtttccgtatctggggacgggggcttcctcttctccgcacaagaactggaaacggcggtccgcttgaacttaaacatcgtgcacctggtttggaatgacgggaactacgacatggttaagttccaagaagaactcaagtatggccacgacgccggggtcaagttcggcccggtggactttgccaagtacgccgagagcttcggcgccacgggactgcgggtcgaaaaggccgctgacctgggcagggttctcgacaaggcctttgccacccaagggccggtcgtggttgacatcccggttgactactccgacaacccggaattgggtaagcagttgattcaggataacattaactagtggaagtgcggaacagcctcctttcgctagcaaagaaatagctgaagaccaacgtttgaataacgcggtctcagctatttttgtggacatatttcagctctgaatggtttctttactgttagacagataacgtactcccaaccacaggcctagtgtctaagtacgggcaatgaacgatcgtgccgcatcaacccttgccctagcttagccatacggcctgccgaggaggttggtcgcactcacttcttgttacttttagaattactctaggcgaatatcagtgtggtaggggcgttgctgttttaattaaaaaccagtcaagcaagttgattgacatcgccgttctttttagatacattagaaccattacaaattaactgtgagggatcgaaatggcactaattgaactgaaaaacgtgacctaccaagtgggcgacgagcaagtgctcaaagaagtgaatttaaaactagaggagggcgattggttcaccctgaccgggccgtcggggtgcgggaagagtaccatcttacgcctgatcgccgacctgatttcggccaccagtggcgaattgacctaccagggtaaggcaatcgagtcctaccaacccgaggaataccggcgccaggtttcctactgtttccaacaggcgaacctgtttggcgaaaccgttcgtgacaacctagaattcccttacttggtgcggggccaaaaactcgaccagaagcgggccgaagcggtcctcaagacggtggcgctggacgcttcctacctagataagaaagtcgctgacttgtctgggggtgaaaagcagcgggtcggcttggtccgcaacctcctctttaccccgcaggtcttgttgctcgatgaagtaacaactgggttggacgaagaaaacaagcggatcgttcgggcgacgatcgaggacgcctaccaacaaggggtcacgatcatggagatcacccacgaccagggtgaacttgccaacgccaagcacttagtcaagatggaagaaaaggggcttttaaatgcataacagtgtcaccgtcagcaacctctccttggtctttgccttcgccctcgtgatggtgtcggtcgggatctccttaaaagaacagctcggcttaaccaaggacgttttgtggagcgtttgccgcgcgatcgtccaactggtaatcgtcggctacgtgctgaagtttatctttaacatcaataacacttggttgacgattttgatgaccctgttcatcatcgtcaacgcctcttggaacgcctacaagcgcgacccgaacccccacagccactattggaactccctggtggccctgttggtcggcacctatatcgtcttgggcgtgttgattttatcgggcgccattaagctgattccatcgcagatcattccggtcaccgggatgatcgccagcaacgggatggtggcgatggggctttgttacaagacgatgaacgcggcctttcacgaccagcgccaacaagtcttagagaaactagccctcggcgccgacgtcaagctcgctagccaagcgattttaaagcggagcatcaagacggcgatgcaaccatcgatcgattcgattaagacggtcgggttagtcagcctgccggggatgatgtcggggctgatctttgccggagttgacccggtttacgccatccgctaccagatcatggtctcctttatgctgttagccacgaccggttttggcgccgtgatttcgggctatttatcctaccgtaactactttaacgaccgccaccaactagtgatcggataaaaaacaggggccccgccggcatggtggggtccctgttttgttagtatgatgttaatcacgattccggtagtcccggacgttttcaaagcggtccagctcagctagttggttagtgtcccgtaaatggtcggcgtactggttggccaggttggggatgacttcttggctgccgggcaccaggtgaatctcctcggtgctggcctcaacggcggtttggtagtactactccttaaacttgaggtagctcagggtttcctcgaggtcgttgagttgctttttcaagttggcctcgtggtccttgagaagctggtagcgcgtcgtcagggtctgatccccgtctaagcgcagggcgacaaactcggcgatctcggcaaccgggacgccggcgttttttaagcaaatgatcgtccgcattaggtgcaaatcattttcggtaaaggagcggcgcccattcttggttcgcgaaacgaaggggagtaagccctgtttgtcgtagtagcgaatcgtatcaatcgaaatgttaagtttggccgaagcctgaccaatcgtgtatgccataggttcctactttcggtcggcagaaagggcgttggctttttgcccctgaatttcgtcgacaatcttagttaagttcgccaagctaccttcgtaagcaaactgccccagtggtaagtggtggactacctcagcctctcgatttggggtggttacgatgcaaaaccaaagggcgccgatcaatcgttcggccaaatcttcaagcagatcgttggtgacgacaccaaggtaatggtggttggtggggtcttttctgaagctaccgcggccgacgccgttgctaaccacaccgatttgatcggggtcggccaggggaccttgattgacccactctttggtaagaagatcttagacggtcagggcgacacgattgtttcccaaattagcccggaacaagttaaaaagaccgcttggacgcccggactgtttgaagccttcaccagagaagactccttaggcctaccggcgctgccgggacaagaaagcatcctctctttgcatactggtcagtttggcgaagctgcaacctccttaccgacggattaagtgaaaatttgaaacggactcacctggggcggtgggttcgttttttggtacaatgagagtactaaagcagaggaagcgatttgatggcaacaacaatcttcggttaccggggctgcccagcccacgaaccggaaaattcaccggccggctttcgctacgccttgacccacggggcggaggggatcgaaaccgacctgcacctaaccaaggacggggtgccggtgattattcatgacgaaaccctgcaccgcaccactaacgggactggccaggtggcggattacaccctggccgagctacggcaatttcggttaccaaacggcgaatgcatcccgacgctagcggattttttacaactggttggcacggcgccggtccagttgaacttggagtgtcaaccaccactgactaaagtcagtggcttgtgagcaagcacccttctgatacacgtgtcctttcaatactttattacgatatttagttccccaaattaaatgatgattaagattgtagactgacgttctaccatatgtaattctttttgtatctttcataccaataattatattacattacggttcgatcatgtgccctaagggcacaaaaaaggtaattcatcacgtccttaaaagaacgtgtttccttgcccgctttcaaaaatgaaatttctttaataatagcacggattgacccagtaagtacccttgagcgctggttttacttttggtggaaatggggagagcttctgttccctcctaaaaattatcgaaaaaccaatcaaagtttgtgatccttccgttagtttgaaaaatagtgtccgaaagttaaacgctcatttcacaagctaggaatggtgatcagatttgcaaaaatgcattaattaaggcctaaatggctagaataatcaaattagctagacaaataattcacgatggtgatcacttttgcttaacaatcatcgcccttttgacttaaaaataaatgatagcgcttgcaaaatgaaaacgagcatgttatatttcaggtgtagaaacgtcacacaggtcgaaacaggaggttcatgaagatgaaagctgcagtttggcatggtgcaaaagacattcgggttgaagatgttgatctgaaaccaactaaggataacgaagtggtggttaaggttgcctggactggaatttgtgggagtgacctccacgaatatcaagagggaccaatcttcatcccggtcggccacaaggataaattaaccggtggtgaagctccggtgaccttgggccacgaattttgcggggtaattgaaaaggttggtaaagacgttaccaagtttaaggttggcgaccacgttagcgttaacccgactgtcacccacggcaaggtgcccgacaacgttgacgtatacgatggctactccttcatcggacttgcttgcgatggtggtttagcgccgttagttaacatcccggaagaaaacctctacctacttccaaaggacttcccgttgcggattgcagccaccattgaaccaacggcggtggccgttcaagccatcaaggaaggtggcctcaagtttggtgaaaacgtggccatcttcggggctggtccaattggggtcttggtagcggcggcggccaaggcggccggggcctccaagatcattgtttccgacctgtcagaggttcgtttgaagaaggcccttgaaatgggggcgaccgacgtcatcaagtccgaccaagaagacgccgtaaagaagattaaagagctcgttccgggcggggtcgacgtctcctttgaagtggctggggtaaagccaacctttgaccaagccatcgaagccactaaggcacggggtacgatggtaattgtggccatttacggccacccaatcgaatttaacccaatgcagctgaccaataccggggttaagatcaccagcacaatcgcttactcccgggaaaccttccaacaaacggtcgacctggttaccaagggctcgttggttgtggaaccggtcatcaccaaggaaatcacgatcgaccaagtggtatccgatgggtttgaagccctcaccaatgataaggcccaagcaaagattttgatcaacgtcgatggcgaagacgactagttaaaacagtaaaaaagagactggaaaacgcagcgtttccagtctctttttgcgttagtagataatcgaggcatgtcccaggttctccgtcatcaggcatcgacgtcaataacgaccttccccatgctctggccagaggcgaggtaagcgtgggcggccggcaggtccctaagggcaaagatgcggtcgggtttcgcggctacctgatacctctgcaggtaggagaagagttcgttaatcttttcttctgtgaccgcccccgagtagcccccggtcaggtaggcgcccggggcgatgtcggcgatcgggtcaaaatgctctagggtccactggttgccgagtagccccgtcacgcagacgatcccgccctcattaacgtgggtgaaggtttccttaaccgtcaccggcccgaccaattcaaggaccttatcaaatttttccgccgtttggagatgcccgttttggtccttaatcacggttgagtaaccagcgtccttcatccgcgcggctttggcaagtgagcgtgaggtgccggcgacgtaggcttgggggtccttggcccggatcaaatttagcatggcaatcccgaccccactggtaccaccgcgaattaagtagcggtcgccaggagcgggccggaggttctttaacgaagtgtaggcggtgtagtaagtctcgggaaagacggccagctgggaccaaggaaggtcggtcgtgaccgggtaaatttgttggttaggtaacagggcgtactcggcgtaactaccgtcaaagttgcgccccatctcccccatgatggaaatgacggcttgtccaacgggtagtcgttgcgggtcggtcgtttgggcgatctcccccaccccttcgatgccgagaatgcgggggaaatgcaccgttggcgattgcccctttctagtgtagacctccgagtggttaagaccaaaggcgtgaatcttaaccagtgaccacccagggcgaagttgcggggttggtaggtcaacgagttttagttggtcgggtcccccggcctggtaaatgacaatcgctttcatcagggcgcctcctcattatttagtgctaaaccgtggtcgaagaaaatgctgcaggattcgtaaaatggcgatgctaaccagggtcagggcgaccgtcatgatgatcccccataacaaggggggcaactgctgggtttggaggccttcaaacagcaagtttcctagcccgccggcgttgatggtggcggcgatcgtagcaatcgacatcgttgacgctagggctacttggaggcccgagaaaatcgccggggtcgccagcggtagttgaaccttgaaaaagacctgccggctagtcatccccattccgtaggcaacctcaactaagctagggtcaattgcccggagtccggtaataaaggtccgcaaaaggacgtactcactgtaaacgactaagacaacggtagcagtagtgtcgcccaacccggttagcggtaggagcaaggcgaaaaaggcgaagctcggcaccgaatacagcagggaaaagacgtaggttaacccagtcaacagccggtcgtggcgtaagcacagcaggattaagagggtggcgatcaacagggcaatcaatagcgacgttaagacgagctgggcgtgctgggcggtatcagttagaatggtggtggcgttttggttccaataagtaatcattgcagtcgcctccagagttcctggttacgctcctcggttgccagtagctcttcaacaaaggggctcgccgggtgttggacgatcgtttccgggctggcaaactgttcgaggcgtcccctgttcatcaccatgacccgctgccccaaataaagcgcctcgttaatgtcgtgggtaacaaagaaaaaggtcttatcggcaagcgaagcgtggaggtttttgatttccttttgcaaatcaatccgggttaaggcatctagggcgccgagcggttcgtcaaagaggatgaaatcggggttggcggccagggcgcgggcgaggccgacgcgttgctgctgccccccggataactgggcggggtagcgatcagcgtactggtcgctgggaagtttgactaggtccaatagttcgtcaactcgctggtcaattttagcttgctcccaccccaacagcttaggaacaacggcgatgttttgcttgattgtcaggtggggaaagagggcaatctgttggaccacgtagccgatgtggcgctgcaggtccacttggttgtgctccgttaattttttaccaccgatcttaaccgtgccgctggtcggttgccaaagaccgttgatcattttgagggtcgtcgtcttccccgagccagatgcccccagcacggtcacgaactcccccttgttaatggtaaaggacaggtccgggatgaccgttgtttgaccaaagcgcttaacgacgtgttcaaattcaatttcgggttggttcatggttttccacctttcggatgaggaggtcgaagccgaccattgtgattaaagagagcatggcgacgctggccccaccaatgatcacgtcggccatgtcatacaggcctaagccggtaaagatcagggtgcctaacccgccggcgccgatataggttgctaaagtggcactagcaatgatttcaatcagggcgagcttaatcccgtttaatagatagggcagggctaagggaacttttacttgccaaagcagttggcgttcgttcattccgagagcgacccctacttcttggtagatcgtcccaacttcattaaagcctaggatcgtgttgattaaaattggtgggatggcaagaatgaccagggcgattccggccgggacaactccggttccaatcagcggaatcaagaggaataagagccccaagctggggatgatccgcaagacctgggaaaatgatgaacaaattagggccaccttggggtgttttgagccgaggtaccctagcggcaggctgatcagcatggcaatcactaagaccgaaaagctcagtaccaggtgttggcccacgtagccccagtactgggcgtggttagtttgaaagtaatggatgatttgcgtaagcacggtcaggacctccggtattaataaagaagaaagtggcaataactgacctagatcagctagaattgctgtgatgggggcgtattttccgcctaatcagcatagaatagtaaggggccgggagaaaattggattttcccctagcccccaatcctagttaatatttttattaaaccagttcttagccacagtttggtagttttgcccgtcgacgtcaacttttttgtttaattccgtcagggttttagttgttaacttcttgtcgacctgatttaaggccttagccatcttcgggtgcgacttgagggtcgaattccgaaccaacgggaccaagttataggctggccacaggtgcttgtcatcctttaagagggtgtatttgttgccattggccagttgcccgtcggtagtcgagaccggcgccgcatcccccttgccttcggagaggatcttgtatttcaagctgtcatcgtagtcctttgaggacttgaagtcgaacttaccgtactttttaaccatccccggcagggcgtcggcccgttggtcaaattccccttgcgagacgaagcgaattttgttggccttcttttgcaggtcgctgatcgtgtagaggccgtactttttggctaccttggtggtaacggcgatcccctgtgaatcattacccggtgccggtgtcagggtcgttaacttatacttagcgacccccttcttggcggccgccgcaatttgcttagcgttcttattggtggtgctttgctttaagtaggcgtccacaattgtccccgtatactcggggtaaacgtcaatttgcccggtttggaccgccttaaaaacgaccgaattagagatattttgtttacgggtcaccttgtaaccggccttttccagggccagggcgtaaatttcactgacgaccttactctcggtgaaactcttggacccgacgataatcggggtcttactattagcggcgaacccggttgttggaagggctagggcccccaaagcagtgacggcaacggtggccaccagtcgccgaacccatttcctcatatttaatcgctcctttttcttagtacttgtgatttcataagtaacaataacacaatcgaatagcttattcaaggctggtgtgataggattaggttatcaaattgtttttacttgtaattaataattgaacgaggtgagaaaatacgtgcttcaacccgctttagcgatgctatccatattttgtgctttctgaaggtttacgaggaggcccgaatcacgagtgacctcttatcatcgagtatcgggatttcaccggtcatggtacggcggttaatggggaacctacggcaggctggcttagtccaaactacccaagggacggcacagccacggttggctagggacctgcagaagattaccttatacgatgtttatttggccgtcgaagagagcgatggtccccaccccctcttcaacgttaaccccgatactaacccccagtgtaaggtcggtggtcacattcaaccaatcctagccgaggtataccaagaggcacaggcggcagcgatgattcggttcaataacgtaaccgtagccgatatcgtggaccagatcaacttgaagttgcaccaagaaaagttacaagactaaaaaggagcgttcacggtttcccgtagcgctcctttttctattcaattcgctttgcctccattgaaaagacaacccggtcgctcaaactattgtgaaccgtgcagtacttatccatcgtctttaggagccggtcaatcgccttatccgtcattgaggtcgctaacttaaccgtcacgtgaacggtggcaagggccttagcccggctccctggtaggtaatcggtggtcccttcaatctcgagctcaaagcgattgacgtctagttgcttgtggcggatcacgtctaaggcggtcagcgacaggcaacccccgagggcccccaataaggattgaaccgggtttggtgctgcatccgtcccttcttgggtcaacggttcgtcaagtaaccactggtgggtgccgtcgttattgatgacttggcaacccacctggcgtaaaacggtgtgaatttggtaatcggccattagtcttcctccgtcatgtccatcattaaaatgaaatcggtctgcgggtcatcgcccaccatgaaggtatgttgactaacccgctgaaagccgtagcgcccatagatcttttgggccgggtagttatgtttccacacccctaaccagacccgcgggacgcccgattttttagcttcttgcatggcaaaatccattatctgccgccctaggtggtgaccttggtatttaacccgcaggtagatgcgctgtaattccatggcgtcggggtaatccggttcggtttgggcgtccttccaggaaagcttcaagaagccaactacttcccccccttcgtttttaaagaagtaggtagcggtgttgggatcggttaattccgcttccattgactcggtggtgtagtattcctttaaaaaggccgccatctcgtctggcggggtgttagcgtcaaaggtcgccttaaaggtttcccgggctaactgttgtaagaccttcattgaggcgggatcgatggtaactagttcgggggtaattttcattgggcaaactccttaacttttcttccattataaaccgaattaaaactaggcgctattaaatgcccagcccgcctagcttagtgcttcaacttcaattggttctcacgctgctccccgggaattaccacgaagacaatgattaccagggcaatagcggcgcagatcgttgacattaatagtgattgacgataagaagccaccccatgggtcatcccaccggtaaccccaacgattaaggcaaggccaacgctggaaccgatctggtgcatcgtattaatcaacccagaagcggcaccggcatctttgggaagcgtgttagcgaccccggccgttgttaatgggctcatgattaatccctggtcgaagccaattaagagcatcgggaggcccagttcgagccagtaaccgttgacaggtgaaagtaaggccatgattagtcaattacaaccgattaaaatcggtggcttgtaactcacaagcctaacggcttagaagtagtaacgcactaatgtgcttcttcacgatgtggctacgtttgggtgattgacaacacccttgattgccaacgtatcagtcggcaacgttgtttaattcaaactttggacgctcgtttccggtaagatattgtttaccaagttcgtaaaggttcattgcgccaacgcgatcatcattagttcggaaaccacagtttgcacagtcgtaacgatgcagtgcatggttacggttttctttgcgaatctgaccgcatttagggcaacgctgactggtgtatttggcggatgccatcaatacttgtgattgattagcttgtgccttgtacgtcagcttaacttgaaggtcgtagaacggccaagaatgcaagtcgcggttatgatcgcgagtgctttgattcttttcatcaaacgatacgttggtcaagtcttccaaaacgaatagggtattttctccatagtgctgtacgagtgtcttagacaggcgatggttaacatcttccatccaacggttctctcgtccagccagtcgtttcagatgacgcttggctgatttggtaccggtagcttgcagttgtttgcgcaagtgggcgtacttcttacgctgataggccacccgtttaccattgaaaaacttagttttcccttgttcatcatagattgtcatgatctgacgcaagccacggtcgatacccacaatgtgctgattgcgaagtttttcccattcgttaacttcaagcgtaaccggaacatgtaagaaccagtgttttttaagttgaactagtttagcagttcctaattttggagagtgtcaagaatgttgtgtaaaaaagtttgagtgcgactaacctccttgacgggtcgtatgggctaagctaggggaaagattagcgcggaacgcggtgttctttacccgtacttagctactagacccgtggttaggagcacgttattgagagtgtgactcagccaaaaaccaagccgtgggctaagttagagtaagcaaattaattcaaaaagctggaggtttcgtctggatagacgttatccccagctttttaattctatcgatcgtttattggttattgctgtattgcagcttttgggcttctttgaagagcttgtctaattcgccggacttcttggcgtccttgatcgtcttgttgacgacctttaagagggccttatcggacttgcgaaccacgacccgcgggtcagaagttttggcgctaatcttaaaggtaatgttcttggcgatggcgtaatcattagggtgttcagccacaaaggcgtccgccgaggtctgggctaatatcaacccatccaaagtccccgccttcacctcttgggacagggtcgtgattgaactttcggtgaccaactttaccccggaaagggacttcccgatcgtttcttgttcggaggattgttgggcacccaacgtggctcccttcaaggcgctgatgccgctgtacttgttttcattagccttagaaaccaacagaacttgacccccgtggtggtaggtactcgagaagctaaccgccttggcccgttccttggtccaaaccatcccggccatcaccatgtcgaacttcttgttttgcagctcactaatcagggatggaaaggcaatgttgacgaacttaaccttcttgaccccgatgtttttggcgattaagtgggctagttcaacgtcgtaaccgacaatttgttgcttaccgtttttaacgatctggaattcatacggtgggtaatcggccgaggttcccacgactaactcacccttctttttgatgtcttggacactggagtcgctagaggagctacacccggctaaactcaccgcccccatcaccactagggccgccaccattaacattttcaaccatttcttccacgccataacaattcctccttatgagttcaatttgaactctctcatgattttttaaaagtatacaccattattttatatttaaccagttaaatttaatatttttgatttttcatgcaattataagcataaaaaagtgggcaatcaccgcaaccagagcgcgaaatccagtcgctcaggttggtgattgcccaccctaatcattatgcttcttccgttttccaagttccgccaaaaagttggctagctaattcatcggccgacaagcggcccccgttttcctcgaagccgcggaacgggcgcaaagccagcatcgccccgtcctggtgcttgcgggcctggtggagtgcgtagtcaaccagtgaaccatccttcatccgctcaactagttggccactcaaggtcgtcttggggtggtcaaccttgtattccaggtcgtcaatgatttccaagcattccggaccggcctgcagttcgttaacgaagatccgcaggtggcgaataaaggccttggccgtggtggcgaaggtgcttggcttggttgggtcttctaaggcgaccgtttcgttcatttcgtcggccagcttcatcacccccgggacctccttaggcgccagggcagtgttcatgatgaagtagccggccaggaggcgaataaaacggagggtcccggtccggatcccgatttgactggttgggtcgaggtcgagcatccgcagttcgatgtattcaactccctctttggccatcgtctttaaatccgcggcgcccttaaaccgaactgggccgtgaaattcagacggcgccagcagttcgccgctttcaacggccgctaaaatcgtttcgacgtaggaatcaattgagctgtaatcgccgctaaacttggtgccaaacccgtactggcgggactggcggatgcagcgaaccggatgttttaagggcgttgcaccgttttcaaaaaagttttgctcggcgatcggactggccccaaataagtaggttaacagccaacggtagcgaacgaagccctgggtaatgatctgatacaggtaattgcgggtcgccacctcgtctttaaagcggtcaggaaagctttcaaacaccactttgaccaggcccggattgatgcttaagttgatgtgggcgccggacggagtcccctcggaaatcgaatggcgcttgagccactcctggaagtacttttccttttccggaccggccttggcaattgggacctgcgagcgatcacggggcaaaattggcggcattgacaacggccacaacaactctcccggggcgagcgccgtgcgtagggcggtattaatgctgtacagatagtggatcgcatcggtggcgttgctggccggtggggtcacgatttcagacatcgtttccaaaaaatcgttggtgatccacgggttttccttttcgtcccccaccgctgccgggtaaggttcctgactcaggtgaccagtttcgtccacccgctgcatttcaatttccaggcccatcttaaaatccgaggcctccaaaatcgcttggtggtcaaagatggcctgcccaatttgactaaacattttctccgccctctttctcactagtttgtaacttttgtttaatttatcagatcacaaccaaaagggcaagctacggtttttgtttaaaataacccttgcctatcattagaaaatgattataattagtaacatcttctctaaggaaaggggttcttaataatgagtacacaaccaattcgtgtcatccgtcaacgggcacaccaggccgtcgccctactacttgttagctagaacccacttttcggcgggttctatttgcaaccagtagggccctcctaacatttaaagttagatctcaaagggagtccctacacgttttacaggggctccttttttgggtccccgaccattgaaaggggtattgattatgacttatcgtttttctaaatttgttcctaaaaccaccaccgatccggtgggcgacatcctacgggtggccggtcaccccggcgtgatctcctttgccgggggactgccggcgccggaactgttcccagttgaaaaggtccaagcggcggcccaggcagcgctcgctgagcatggcgccgccgccctccaatatggtagcgcccaaggcgttccccagctcctcgacgtcatcaccgaccgaattaagcgggagcagatcaacgcgacacgagaaaacgtactggtcaccaccggctcccagcaggtcctcgacctggtggccaaactctttatcaacccgggtgactccgtgatcgtcgaagaacccacctatctctgtgccgttgacgccttcaagtcttacggcgctaacttagtcggggtcgaaatggacgacgatgggatccgggttgacgagctcgaacaagtccttaagaaccgggatgacgttaagctcctctacaccatccccaactaccagaacccgaccgggcgctcgatgccggcagaacggcgccaacagatcgcccaactggcggaaaagtgcgacctgatcgtcttagaagacaacccctacggcgaaatcaacttcaccggcgaacggatcccgtcgatcaagtcgtatgatcagagtggccacgtcatctacacatcaaccttctccaagatcttggcaccggggatgcgggttggctggctgatcgcagacgaggaattgatcccccacttcacgatgctcaagcaaaccgtcgacctgcacaccgataatttcacccagtacacgatcgccaagttctttgagcaaaatgacgtcgatgaacacgtccggcaaatcaccgacctttaccgcagccgcaaggacgccatgatcgcggcgatggaaaagtacttcccggccgacgtcaaattctcccggcccaccggggggatgttcctctgggtcgaggttccgggtggggtggacacccaagccctgtttaacgagtgcatcgctaatcacgttgccttcgtgccgggcgagcccttctacccgaaggacgcgcccgccggcaagttccgcttgaacttctctaacaccccggctgaccagattgaggtcggcatccagcgcttggcggaggccatggtcgctacaccggtctaaacacggaaaactaaaacgccctgctgagcaagcgactcaccagggcgttttagttttatttatccgattatcaattttatgaatatgatggaaggggatacttaggcattttctgtttacaccaaaaaagagcaaggggtcggaaaaacagatttttcccggtcccttgctctttttaatcgcgtacttggtacacccagttgccgttgaccatcaccgccgctaccgttgagcggttagcctggtacatcaggcgttcaaagcgttccagggggctttcgcttggccacgggtgcgggtcggttaaaatctggaggtcggcttgacgaccggcttcgattgccccaactggcaggtttaaggcctccgccccacccttggtcgccaggtagaaggcggtgggcattgaaatccgggagtcgggggccccttggtcggcattggttaccccatcggtacggacctgggaaagggcgacggcgtggcggatgttatcgtacaggctcggcgagtaaccaccggagatgtcggtcccgagcccgacctcgttgcccgccgccagtaattgcttaaccggtagcacgccattaccgaagtaggcgttagaaattgggcagtgggccagggccgttcctcgctcgtgcagtaacttcgcgtccgcctcggtcagctgggttccgtgggccagcaccgtcttgtcggttaagaggccaaaacgatccagcacttcggcgtcgtgaattccgaaccggtcaatcgcgtactggtgctcccagttgctttccgacacgtgggattggattggcaggtcgtacttttgcgctagtttccccaaaccagccagggttccatcggtgcacgatggcacgaagcggggcgtgatcaccggtagcggcgccagtggctcgtcttgacccagtaattctagggcctggatgaaacgttcggtctcggcgatcgcctcctcgctgcttcgatcgcggtaataggccggggtttggtcgggattatccatcgccacacgcccgatcgcgctccgtaagccctgatccatgcactcgcgggccaggaccaagttggcctcggtgtggatggtgccgaaaaagaggaccgtcgtggttccgttggctaagagggtgtggaccaggtcgtggtagaccgtttggacgaactcaaggtcctcgtacttagcctccaagggaaaagtgtaatcgttgagccattcgttgagcggcttatcgagggcgtggccagcctggggccactgcggggcgtggacgtgcaggtccacaaagccgggcacgagcacttggccgggggttagtttggtcagccggccgtccgcttgggcttgtcgcaggtgtccttggtagtcggcatcgttgggcgttaaaacggcgataatcttgccggtttggttaatttcaaccagggcgtcttgaaggtaggcaacgtggtgcgggtcgtccggtgtgtagactggcccgagaatggcggtttttaacatggcttcctcctatgaatgtgacagcttaccgtttaatgttatcacgaacttttttataaaaaaagcaacgcccctactttcatcactgaaaattagggcgctgcacttttaactaaaacggttacttgccgaagaattcattagcgaactgttggtagaaggcaatcgcctggtgataggcggcgaggctgacccattcgttaggctggtgctgactgtcactgccggggccgaccatcacgattgggtagtcacccttggcccgaacgaactcggagccgtcactagccccggttccgccgaccggggtcaaggtgtgaccaaagacctccaggccaaccttttgaagcagttgaaccagcggggagtgggcgtcgccgggcatcggttcctcggggtaaatgtaatcgacgctgagctggtagcccggcttggcgtttaattcggcgatcaagccatcgatcacatcaaagatcacctggttagtgtaacccgggatcgtccggatgttgccagagagctcggcttgggacgggacggaattaatctgttcaccgcccttaatcagggtaatcaaactggtaagtttcccgagtaccggatcctttttatccaagcgggctaggcgggcttgaacctcattggcaaactccaagaggtgggcgattgcatcttcaccctcgtggggcctagaagagtgggcggcgattcccttggaggtaacgtggtagtccacgacgcccttgctggtgtagcaaatttgccgcattccgtcggtcggttcggcgatcaccaacgcactcaggtcgtcggcgagcccggcatcggtgacttgcgccgccccgtattcgccggattcttcaccgaccgtggcgattaacttgatcttgcccgggaccttcttttcttccagcatggccagcatcgcgcagacaaccgccgccaagccactcttcatgtccgaagcaccacgcccaatcaggcgcccctccttgatggtcggtacaaaggggtcggtgtcccaatcagccaggtcaccggggtccacaacgtcttggtgtccggaaaagcctaacgtggtctccccctccccaatcgtgacaatcaaattgctgcggccgggtgaatatgccaactcctcaatcgtaaccccctgatcttcgtaaggggcaaagagactcgctaagtaatcggcgacctctttttcattatcattcacggttggaatggcgatcaccttttttaaaatctcctctgcgtgcgcttgatccatgacggttcctcctcttaaaatatttaagcatatcatacacttgttatacattataaacaagttaatcccgttttttattaataatatttgcatgtttaatcattagcggatcaaaaagctcccccagcggtgctgcatgggggagcttttattaatttgaaaaatttactttttccaggaattgcaggttttgcataaggttgaaatggatctacttcctttcaaaatactcctactattgaacgttcaaccacccctacttaatttcggcgtggcgggcggatgaagtcgagcttagtaatcacttcgattaactgggaaatggttagcagcagggccccaccttgaaccgtcgtctttagaaacccgctggacgcatcgaagtagtgcttggcacctgctaattccatcacgtgcttaatctaattgttggtgtagcccgcatcagaaaattcgtcctttaaccaaccggtgtcgacgatttggtactggtcagcaccaattagatcaatgtagagatggtaattttcgtgaacatccgcatcataaaccggtagttgaacctggatcccatcttcttccgtgttcttaaagctgatctggtccttggcccaatcgtggtattgttccgctagttcctgggcgtcaaaaattggcttgttagggcgcttttgcccttcttcgtccaattcacgggggggcggtccaaccccatccccgccgtcatcaccaccaatatccggccaaattcactgatcgtgccggccgggaacttttccgggtggttgcgctaggtattgcgaacgtaactttcgccgtggccccagatcttagaggctttcttgagcggccttgttaatgacccgtaaaaatcaacaatctctataacgtcgtacataggggtttaatggcttagcgccctaattttgttgtttgcaatgcttcttttagttctttgacccgttcttcaagctggtcaattacctggttaaatttatcatcacccagaccagttggatcgtccagcccccaatcctggcgcatttgagcgggcaggctggggcactggacgccacagcccatcgtaatcactacgtccacctggggaaggtcggtcagggccttgttgtgttgcccattggccaacatgtcaattccgtagcgctccttaacaagccggacggcatccgggttaatcgtccttttgggggcagttcccgccgagtaactatcaaaaacgtcgctggccaaatggcggcctagcgcctcggcgatctggctccggcaggaattgtgggtgcaaataaaggcaaccttgggttttgtcatagccattcctcccttacttgttgggccctttcaaagtcgtcggtgaaaatcccggcaacgccccgcctaaataagtcagcctgtacggccgggtcattaaccgtccaaatccgctgggggaccgtcgcccccgctaaatagtggtgtgggtgaattcccgctaactggtattcctgacagaaggcatccggatcctttaagtcacggtcagttaagtaacagtattcaaagcctgggtcaattgactgggccaccagtagtgaagctaagttaaaggaagaaaagatcactggcttagcgagcggggcctctttaaccagtggtaagaccgtctcctcaatccccgggtagcgctcgacgtcagctaactgtttgaaaaataacccaattttttgttgacgacttttgtctcgcactcttcattatttatcacgatgataaaaatcttttgtattaaagaagtcatttagaaccgtgttctcaccagtcattgtttcatgtaaacgaataccatcgacatttatccgcgcattacgataataatcatttgttaattgaccccatgatgtctgtgacgcatcaacattatcgaaaatactgaaaccgctactcttaagataagtgtactttgcattatcatttgtataatttgtaaatgagccaatatctgctccaaatgggaaaatcaatactggtgttttaccaacaattggttgtacttccttttgccaaagtgcagtgtcctttttgatatcatcaacactggccgtagtcatatttatatgaccccaggaatgcgatgcaaactgccaaccttcctttttcatagcgttagcaacctttgtcgctttcttagcttcgcgatgtgtggtttttgtatcaccatattgactctttgatgaacgataacctagcaccccattataacccgtttcagcaatcacaccctttgagccaccgtatgagaaatctggatgctttttgatgaaggtatcaataatcggtaccatgtcataatcaccaattttcttctgaccattattggtatattgatttttaacatcaccttgcttattgacgactaatttatctgcaaatccagaattcttcatatactcataatagttaacatcatcctgtgatataattaaaggcttcttgccttcaggtaatttgactggtttgaaagtcaccttcccttgtttatcaatcgaaatgatatctttaaagttaattaatacatagccattatcatataactgattcagcatcggcataaattcgtcgatggtcaccatataatctttgtatccctgtgcctgcttagatgagaaagctttaccaggatcaacaattagtgaatgaaaaaaagatgtgaaatttttgtcggatcatcccacgtgaccaactttgactgttgcttattaatactcttttttagatgatcaactgttgttcctttgtgccccgataacactgattttgcttctttatattggtactgttgacttaatgattttgcctgctttactatcttagttgtttgactatcagtttttgcagccataacatcatcatcaatgttgccatataaccctaagcctgctcccaaaatcaacccaatgacaagactagttatcttgatttttatcacagctactcccccataatttttatgaatattaaacgacaagttagtgccattctatatcttattacctcaaaattgaactactcccacttagctaagcctacggcttgacgcttgaagtgggagattctgggaacatcgcatacttactctaccggttctaagtgaactttcgagcagaggttacgactattgaccaaggcccgtcccaggcctaaatagcttaattattgggtagctaacccctttttcagaattacttgagctgcattgatatcgcgatctaggcgggtcccgcagttgggacaatcccattcacgaatgtctagccattccgatttatctaaacctaaccgatggttgtttttcccacagttaatacagatttgactagtataaaacgccgcaattcacgcatgttagccaaattgtgatcatcaatcaattcacaaacattattcagcaaatcgtctttgtcctcggcgtcctttgattcatgcgtttacctccaatgcagttagatttagatgacttttctgatttacttctttttcatctgtatcctgattatctgataaatgaaagataaaatgactgtgataattgcaaatacaaaagttagtgtgttctttccctgaaataggaacaacactatcgtaattaacgacgtgatgatcgcaactattcgtactaataaatctggtttgttcatgcttcttactcactttcaaatggttggttgttttgctaaatgtagggatgccgtgagctgtggaggctagagcggtatccctctttttattatattcccctcatattaaaaacgtgggttacgaataaaattattatgaatttctacttgaactaccgcgcgaccacggcgtgcttgaaataactctaagtccatatccccaatttcaaggttaatttcttcaattgctgggtttaaaatattatctttcaatcgtccataggtataactttctggcgcacctagccattctttccactcatcaggcgttccttggacaacggcaattgaactaccgttatctttttcagcttcacgcatgagtttataaagcaaaatagaatatttacttttcagtttaacggtatcaacgagtaaatattgggtgtagtgtcctttatcttttaattgcaacagaaatggcgggttctggtgcaaaaaattcagtttaacttattttgggtataattagcctaaaaggtgaggtagatatgatgaaaaattattttaaaggtcggcatttccaacaagacattattttggtagccgttggttactacttcagatttaatttgagttatcgtgatgtggttgagattttacgtgatcgtggaattactgttcatcatacaacgattatgcgctgggttcatcactacggaccaatctttcaggtgttgtggcgtcggcataaacattcagcttctcaaagttggcgagtggatgagacttacatcaaggttaaaggtcaatggtgctatttgtatcgcgccattgacaatcagggattaacgctagactttgagttacgtaaacatcgtgattatcagtccgcttaccatttcttgaaacgattatttacgaccgatggtcgtcccaattgtttggtaactgaccaatatggtggaactttaaaagccattaagcaagtgattaaagacggcttattggagaaagcaaatcatcaatgttccaaatatcgcaataatctaattgagcaagaccatcgattcattaaacgacatcgggttcgctcagctggttttcaaaccatccgaactgccgctaaaactttagccggggttgaagttgtccatgcgattcgaaaagaaacccgaagaaatggtagtttcttcgggttttcagtaaccgctgaattgaagcaattattgatagcgtaagctgtcaatatccaagaaaagttagttaatgtgcatttgttttaaattttgcaccagaaccctcgcaagttataaacatgacagactttaccaaatagctcctcagtcgtaactgctagatcccccttgagctgtttcttattttcattaaagataggggtgccggtgtaaccataccaattactattgacaaacgctgcccgaatttccttttgcatcttaccaaactgcgaccggtgggcttcgtcaacaaagaagatcactcgttgctttaaagtcttactaaagcgggattgcttaccggttgccagctgggcttgcgtttttttgaccgcccgatggagtttttgaatcgaggtgaccaagactttaccgtcattttgttgcaatttacgcattaaatcaccggtgttttgggcttcgttaatggcgatatcatcattggcggcataggcactaaagttgctagttgtctgttcgtctaaatctttccggtcaactaagaagatgaccttatcgacaccaggatcttgcgcagctaatttagcggttttatatgaggtgagtgttttaccagaacccgtggtatgccaaacaaagccatcttgatggtcgtgaatccggtgcatcacggcttcaatcgcataaatctgataaggccgtaagagaattaagctctgacgttcttggtcgatgaccgtatattcactgaccattttgtgggccatgggaatattaaggacttggcgcgtgaacgctaagccgttttccacggggtgattatcccgtgtccgccaattaaacaaaaaggctttgttgaaacgatccggttcggcattcgcaaaatacgccgtactatctggcgtcataattacaaacatttgcagcagcgagtaaatccccgtatatttaccttcttgcgcgtatttttcaatttgattaaaagcctggttaagttcaaccgtggctttttttagttccaattgaattaagggtaacccattaatcaatagggttacgtcaaaccggcgatcaggatcgatatcttgagtaccagctaaccgtggtcgcactgcttgccgtaccacttcataactagatttaccgccggcgacgtccgctttccagaacaactcaagcgtcaccgtgcccagcttagcatcatcacgttcgatttccactttgccaatgccattttcggcggctagtaatttagccgcttcataaggtgtccggacctcaatcgcccgtttaacttgattaaattcagtatcagttaaagggtgtccctgcaatttagcatagttattgttatttaatttatcacgaaaattagcccataattgatcaggagtggcaccatataggtcttttcgttccacccattgattacttccagtcgttaaggttttaacaacttctttttcaaatgacagttccaacataaaaacattccttcccccacctttaaattactcactagtttattatacgcgaacagattagcatttaggcttcataatttaatatagccaggatacaataaggttgaaatagatagacaagttctgattaattaatggtggtagaattaacgtaaagattaagtaacttggtgttctaaaaactgatgaaagccaacaaaaagaaatctatattgtgaaaaaatcgacagtattatgagggaaagaagaaccattcatatgttaaaagttgataaggctattttagatacaaatagagtaatatgtgctaatatttctcaactaagcttttccgatagggggcttttgagtcaaaatattcttggtcaaattcgaaattttgtggagtatattgcgatcaaagcatgttccaatggtcaaaatattgatcccaatgactataatttgaatgtacagtctttgaaagatgttcagcgccggggagatctgcgattcctgtatcagttccacgaaatgttacaaaaatctgtgtcgcattataccgttggtagggatggctcagagcgtctcatgctcaaatactatgagcatctactgaagatcaagctatacttgaaacaaactttcaatttggatgtattggagaacattagtgattttccgatgaatacagacactgaactttcggattattatgaaaaaattgctaaaagaatcgaattcccgagtatccatagttatccagttacttataacgaccggtattatgtgcaaaaagttaagccttttttcgttaatcaaaagatctattatgaaattacgtttactgcagcaaatgctaatgcaagtaagtttgacagaataattgcgtttacgcagcaagagattgtagataactatgctgtgaaattttcaatacgcaatgacataattcatattctaaatatagatatgcccattctcgtgatcaatggatatgaggtatccattcgcccttgcgagtgggataatttctctgagatatttggttcgagatctaaaaatagcagtaactccaatgaatataaaagattgatggagtatatttctagtgcaaagctatccttaacggagcttgttagtagcgatcaagattactatgattctatcaagaaacagattacaggcaacattaaatcgaccaagatttataaaatgcttgatcaatgtcgaaagataatagtcgataatgatccaggggcaaatgtattgagatatttgctttataaaatgaataaccgtgtcatcaggcagcagtattcacgcgaacaatgtcattatttatctaacctttacctgagttatagttgtattccatttgataacatgccttattgcacttctctgcgacgacacaatccaaaattatatgatttatttaactctattcccatttccggtcacaaacacgaattgtttgctagatacattaaaaacaacactgaaatagaggggcatctatttacacctaaatctgaagttggtggctttgaagatgttgataatttaatagaaaaatacaactcttctctgtatagtaagcattctggacgtagaatcgaagaatataaagatcatctttacatcagaggttatgtcgatgatagcaccaatataatcaaaacattgcagaaactggcttcttcgggcgtttctcaatatacagcctctgtggattcatggatatcagaaaaagcatatacaattgatgatgagggtaagaaaaaagctctccagcagatgtttgccaattctcatgtcgcgctgatttatggccctgctggtaccggtaaatctacgttgatcaagcatatatctaatttttgggcaaataagcataagatattccttgctaatacacaccccgccgtagataacatgaggaggatggttaccgctggaaatagtgattataatacgattgccaagtttctctcgagaggcaataatagtacggattgcgatgttctatttatggacgagtgtagtacagtcagtaatgatgatatgcagcatgttttgaagaaagcaaaattcaagttgcttgttcttgttggtgatatttatcagatagagtcaatctactttggaaactggtttagtattgctcaaaattttgtacctaaaacatcaatatttgaattgacccatccatatcgaacaactgatagcaatttgctgacggtttggaaacgggtacgccaacttgatggtgcagttacagaaccactagtgaaaaataattatgtagagagactgagtcaatccatttttgaacatagtgaggaagatgaaatcattctttgcttgaattatgacgggctatatgggatcaataatattaatcggctcctgcaaagcagtaatcctaataaacgttttatctggggaatgaacgcttataaagtaggggatccaattttatttaatgagtcgaatattttttctccactaatccataataattcaaagggaagaatcgttggtatccgtcctgaagataataaaatatgtttcgaaattgagcttgatgaatcattgaatgaaattgatgcgttaccatatgattttaaacttattggggaatccaaggagggaaactctattatcttgttcagtgtaaacaagtttcggagcaccgatgaggacgatgaagatgacgattctaccattgttccatttcaaattgcatatgcagtttctatccacaaggcacagggcctggaatacgactctgtaaaaatcgtgattacaaatgaaactgaggaaagtattacacagaatatattttatacagctatcacacgtgctaagaataaattaaagatttactggagtcccgaaacggaacagtctgtgctcggaagattcaaatctaaatattctgcaaaagatgcacacttgctatctaaaatttcttcaatcaatatggtgagttaacgtagactaacatatcgagtagctatacagagaatataatttgccatttgaaatctaagtttaaagattacagtagcaacaaaaatgatatgctttaaagaataaatacgttgatataggagattttaatgaaaagtatttgggagatggacgcaccaataggcttggcttttttctttggtccagctttaattattggaattatgatgttaataagtggttttaacaccgtttcagccattatggtcttagtgttagttttgtgtgggcttaaatacatgcatacttcaataattggtaagtatagaataatgaaatctattgttaacagtattcatttaaaaaaagacagtaagatattagacgctggctgtggtcacggtgccttcatgttgcaatttaacggacaagcggcaaacataagcgaaataataggaattgatatctggagtaataaggatcagggaagtaattcaattgcagctactcaaaaaataatggaaaatagtaatttggctgacaaggtaaagttgaaaactgctaatatcttagacatgccattcaacgataatgaatttgatctgattgtatctagtttggtactgcataatattaagccatttgagaaacggaaagtagcgcttgtaaacatagcaagggttcaaaaacaaaaaggtcagttagtaatcatggatataggctacgaaactagtaaatatgtgcgtattcttaaagaattgggatatcaaaacgttaatattttaaatgctggctataacggttggtggggtaccccgatggttccaacttttgtgataactgcgaccaaataaaaacagtatccgtcacactaatagggagaatacagagggaggaagtccttatgaaagaatcaaggattttacgttattgggaagcatttcaaaaagtgagtggtgtaacaggagaacattatctggcagagcaatttggaagcaacgcccaccacttggcgagcgttgcttagattgtgcgctgtgtttagaggtcccgttccggagccttccccagttccgcttggatcatccaaagccgcttttcggtcgcggtcttgaagccaatgaagatgtcctgggtggagaagtccttttcatcgtcactaatctcgatcccatgctggtagagatcggctaagtaacggtagtccttggctagcacttcgaaccgttcgggcgttgacttgttccagttgcctggttcgtcgggaatcttggtgtgttccgccatttccttaagggtggagtatggtgaaccatcaagggcgatcagccgttcggaaatttcgtctagttggtcgttcaaatcgtccatccagtcgtccatcagcgggtggagcttcaagaagttttccccgcgcatgtaccagtgggtttggtgaaccaccatcaccagttggctcaggtcagcaacgagttggttgagtacttccttggtcttttcgtatttcatgaattaaacctccctttacgtaaataaggtaacacaatttaaaaccgctttcaaatgttttgcttaaacgcgcaacgcccctagtctaggcgttcaattttaccggcggcaatcggtaaggtaacgtgttgttcgtacttgtcgttaagcttacccgccacggtcgccggcaattctaattccgccggtaccccgtggacgtagacgacccgcttatcaagggccagtgcttggtcgtggaagacctccttgaacttagcctctagcttagccaacgggacgtccttttcgtaactgtagtagcccgttgcgtcggccaccgggtagttatcgttggggatgttcatctcgtggggagcggcatccagtggcaccatcgtcgtcccggagacgggctcggtttccggtaggtcaatgtagccatcgtggttaacgtcttgggcctcagttggaatactggcgtccttgccatccgggaaaccatggaagtgctcccagtgctggatattagcgggggtatcaaacatctccaacttaatgtggagattatcgccttcggtggtgaattctacgtagccgtgcgcctcagtcccaattttggcggcgttgagcggcttaatttccgcacggtatttagtcatcaaaattcctccaatccaattttaagtgttcccaatctgggatcattgtagcgcttgcggcccaaaagtgaattgataaggatcaaggataagcaaaagcggtggaaagaaacgaaccagactgcggaggggagacaggacaaatgtttggatttgtgcaataaagtgagtgcgaccaacctcctcgacaggccgttgggctaagctagggcgggggttagtgcggtacgcactgttctctgcccgtacttagccactaagcctgtggttgggagcacgttatctggaaaagcgaccaacctcctcgacaagccgttgggtcgcacttccattttgcgtaaatttgcagatttgtcctgtcctatttgccgctttgtcctcaaactggaagtggctcccgaccttcccaacggtagagaaaaaagcatcaaaaaagaggcggtgacacattggtcactgccccttaatttcactaataaccgaacgctgagcccgtggtccccgtcccgtaggagctagtcccgtatgaactagtgccataagagctggtgccgtagctagagctggtcgaagaagaactggtgccgctgcccgggctattgtaagaagccccgtttggtagaacaaagttaacgttggtgtaaccatcgtaagtcgtttgctcgttgtacatccttgtttcggcgttggtaacggtcttggtcttcaagcctaattgggtccgaattaacttagaaatccggttaatttcctttggcgtggcgatttggaaggaaacaccttcgatcgtcgcatccaggtcttgcatgtggtaggtcttaacgttatccatggcggcgtggtagttggtgtacaaagcagccacgttgtcaatcggaatatcggtcttcaccccgtccccgacggcctttaagatgtcgttggccgcggtgatgctcccggacttcttaaaggtcttgatgacggattccatcacttgttgctggcgcttttgccggccgtagtccccgtttggatcgtcgtaacgcatccgggagtacttcagggcgttggccccgttcaagtgttgcttccccttcttaaagtggtgcccttcataagtgaaggcgaacgggttgtcgacggtgaccccaccaacggcgttaaccaccttttccaagacccccatgttgatcacggcgtagtaatcaatcggtacgccgagtaattccttaacctgcttgacggtttgcttggccccgccgatttggtaggtggcgttgatcttaacgtaatcggccccttcgtcggtgttcaccttgatcagggtatcacgcggaatcgaggtcattgtaatcgtcttcttcttggggttaatcgtgatcaattccagggtatcggtgttcccaccggtattcccccggtttaaggcccccacgtcggtccccatcgctaaaattgagatcggcttaccggcctttaacttcgctgagatcttcccgctcccgctagagaagacatccttagcggtgctattgatttggtggtattcataggcccccccggccacaattaacaagaggatcaagaagatgatccgcttcacccacttaaaccacttcttaccgccccggtagtatggcgggtggggattgcgcccgttgccaccggttccggcaccgttcgtaccagactcgggttggttgtttacccggcgccggtagtcggcacgcgtttcgttttcttcgttcataactacaatacctcaacagtgatataacatttttactaacgttaccactttatcagaaccatctaattgtggtcaatttgccccggtgattttaataaatccgtaaggtctttacttatttttcaccagtcaaaaggcgagctgacgggcgttcagcgaacggacgtcgactacgggattaaaaaaggggcgcacccattcgcagatgcatcccagattcttctaattttggtcaccgcggattttatctaacaggtcaccaaaggtttgcttttcttccgccgtcaggttcttaaagagcccctcaaacatcgtcttttgggcgtcttccacttcagcggcccgtgccttacccaggtcggttaagaagagcagggttgcccgcttatccttcgggtcaacctcgcgctttaggtagtcgtcgtcttctaacttgctaaccagctcggaagtcgaggattggttgataccaaagccctcggccagttccttttgccgaatgccgtcagggtgcttaccgattaacactaagaggtgttcgcgactgtgaccatgccccagccccggcttggcaaatggcggcatgtggtgcctccccatcatcatgcccgggcccatgccgccgtgcattgggcagccctggccgtttggtccgtgttcgtggtggtggcacttgccccccattgggccggagccgtggacccgtttgtgcaggcccttcaccgtcttcatcagcttatgcattaactcttggtcgttgatttccgtcatgttacttcatcccttcgtattaggttgattttaatttacttcggtaccgatggctttaggataaccccagcgaagcggtaagtcaatttatttcgtcaccgaagtaatttacactttaggaccccgctcccggtactggcggggagtcaccccggtccggcgcttaaggcactggctgaaaaattcaatcgaggaagagaattgaccatgttatcaaaatacgtatacggcctttcgctgggccactttgactttagccagggggcgttggccgccctgttacccctcctaattgcccaacaccacttcaactacgccattgccgccaccctggtctttgccatgaacctggtttcttcaattattcaaccgctgtttggctttttatccgaccgtttccgtaccggttggataattatcccggcccttttaatcaccggtctgggcttcgggacgctcggttgggataaccaatacttcctcttgattaccagctgcttagtctgcggggtcggaatcgccgcctaccaccccgacgccgccaagttggttaacggtttggccgatgttaaccagggccacggccctgagcgttttctcctttggtggtaacctgggctttgcctgcgggccgatcacggtcactttgatcgctaacgccctggggatttccggggttggcctctttatcctggtgggcggcggagtagccttattgttagcgcactacttccccgccatgcgtcggcaatcagcccaacactggcaacaaaagcggcaacgagaaagtggctccccggttccggttaaagacgactggcgccacttcgccattttagcttgcgttttattcgggcgttcaattattttttacgggcttaacaccttcttggtcctctactggatgcacattctcaagcagtctaacaccagcgggagtttagccctcagcgttctctttatcgtaggggcgaccgggacgatcatcggcggtcacttggtcgaccacattggcgccgtcaaaacgattcggttcgcctttaccatcatgcccttcttgttgctggcctttagcttaaccaagagcgttatcgttgccagcgccctcctcttgccgatcgggatgttaattttcatcccttacagcgcgattgtcctgctgggccagcgctacttgcctaaccagatgggcttggcttccggggttaccctcggcctggccatcagcatcggtgggattgccaccccctttttgggccaggttgccgatgccacgagcctaatcaccgtcttcttcatcctgacggcggttgccctcatcccaatgggggccgcatatttcattatcgaaccaaccattaagtaagctataatttaggtaaaaaggaggcgcccctatgcaaactacctgccattaccaatcccctttaggtgacattttactggtcagcgacgaacaaggggtgtgcggcctctggtttgaagacggccgctactatgccgatacggttgaagacgacgcccaagcaggaaccagcccggcactagaccaggcccgccgctggcttgacgaatattttgccggccaagccccgacttggctaccgcccctccacgttcagggaacccccttccaacgacaggtttgggaacggttactgacgatcccctacggccacctgttaacttacggcgagctagctaaacgggtggcgaagcttcgccaccggacctccatgtctgcccaggcggtcggcaacgccgtcggtaaaaaccacctctccttgttcatcccctgccaccgggtcatcggggcgcacggtaacttgatcggttacggaggtggcttagaacgtaaaatcgccctacttgaattagaagggcatttggcaagtgacttttcttggccatcctaatttcccgggaaattttttgaacaaacagggggcgccccacctttatttatcttataattaaagtaattcattgcgaagggagcccgtaccgtgttattgatccaccaagccattaacgccattggggaactggtcctcgccctgaccatcccctttttgtggtggttaattgtcacccggcgccaagtccgcttcgaccgttggttgggctttttcctcccgccggtccaacgcacctggctgacgaccgtcatcgtcgtcttgttcacccttttgctggcgatccccctccccctgattgtcgaccacgggatcttggccacctttgttttcaatcaccggggcttcgccggcatcccggctgcgctggtgtacgcgatcgtggggacctctttgcccgaggagatccttttccggggcttcttactcaagcgcctccaggaccgcttcggctttttgcccgccaacctcacccaggcaatttgctttggggcggtccacggcctcttgctggcgggcgccgggaactggctggtcaccctgatcatcgtcctaatcgaaatggtgattggctactgcctgggctggctcaacgaacgccgtagtggcggttcgctgtacaccagctgggggatccacgccctcttaaacaccgtttccgctttgattgccctattcacctaattgaggagtgatttttttgcaaaccgcgaacctgttaatcgccaccctgctcttgatcgccggcatcatcgtcctctacctgggggtcttcgctaaggaaatcgaacacccaaccggcactaaccgcctcttccaacgcctcagcgggctgggaattaaggcttcgatgcggccggccctgatcgtgaccggcgtcgtcttagttggggcgtccctatacatttttggtggcatttaaaaaggaccgggagaaccattttttctcccgatcctttttacttgcttgccgttaacacccgcgtcaccatcaccccgtagaccccatcgaggccggcgttggtaacttcaatttcctgggcgcctagcgtggccagcgcccgccggtattcaccgctgtgttcaatgtcgatgatcgctaaccggccgccgggcttgagaacccgcagcgcctcggtcaatgcctggcgccgcgcttgcttgggcttgacgttgtggagcgacaggctagcaaaaacggcgtcgaattggttgtcattaaagggtaacgccgtcatgtcggcggtttgcagttgcgcaacctggctaaccccggccgcttcaattaccgcttgggtggccgcctggcggttgccagattggtcgaccctcttccagatgtcaatcccggttaccttgccgggcgcccttaagtgcttagccacggctagcatcacggcgccgtgaccacagccgaggtctaaaacctgatccgtagcggcgatccgggttttacccaccacccggtcaatgatcttgtttttgccaaccagcgaggtgcgcagatacaggtaggtacaagcgaaaaatacgagcgccaacgggacggtgatccaagtgtgacccgccattcccgccactaattctaaaatcccggccagccctaacaaaatggggaccagcggggcgtcaacggtacgtttcatcattatttcctccgggaacttgttttgctaattataccaatttcccgggaaataaaccgacccccagccaaatttgctgagggtcggttttaattttcaactgttggccttgcttagccaaacggtctatcgaggaggttagtcgcacttctcataacgctcttcctacttaatgaccccaaagccgccggtccagccgatttgttcactggcggccaaggtcatttgcaagaagccagttgcttccagttcacgggcccgcttgagcttgccggcatcgagtacggccaagggactgccctttaaagcctccttgaaggtcgccttggcgtcatcatcgtcaccggccaccaggacggtcgtttgttgttggccgccaacttggccgctttgcagagtagcggcgaaggtcgtgttaaaggcctttaagaccttgctgtttggcaggcgcttttgcagttcctgggcggccgagctgtcggcgggaaccactaattcgtcccaggtctcaaagttgagcgggttggtgatgtccacgaccaccttaccggccaattggtcaccgtattggtcggctaagtctgccaacgccgggtacggtaccgccatgatcaccaggtcccccaagctaaaaatgtcatcattggaacctacgtaggtgactgtgttaccggccagttcgaagttgtggccaatggcttgccccatgttacccttaccaaaaattgtaattttcatgattaagcttcctttttgttttcgtgttctgcgatgttagcaagtgtctcgtcgaccagttgttgaaccgtaatttggtccaggcgctgttcaatcccgacttgaacctcagcaaagtgcttggtaatcacctccggaaaggcgaccccgacgctacactggcccgaggtttcttgatccggcaccaagaaggggttcttgggcgcggtggcccggtaaacgtccaacaccgtgatctgatcaaggtcacgggcaaagttatcgtagcggttgttttgccgggccgctaaaatatcggcggcccgtagttgggcaatcatcttgcgcacctgactcgggttggtttttaaactcgaggcgagaatctggctagatacctcttctccttggtggacctttaggtaaacgaggatctgcagtagatcactaacgcgggtattggcgatcgtgtccccctcctttctcttttctctttcaacttggccttaggataacacttactttttggaagtgcaacttttttagtaacactaattcaaataaaaaaagccgtgctggaataatgtacttcacgaatcagtttatttccgctaaaagaaatgaccaaaccgtggcggaatattaccacgatttggttggataagaaaaattgtgttttcgtttttataagtgttaacttgacaggggatagtacccttcgatttgttgggcaatcttatccaatcagttctggccttatagctacttcttgttcattggtgcggtattttgctcctcagacttccttcagattccacttcacagtggacacccttgtccttggctaatggttccgactactacggcccacagtggactttcaccacctagttagcgcccatgccgggcgcacccaaaaaatgccgcacccccaaaaggagatgcagcatttcaatcacgcatttaataatccaaatgccccgcgagcttcagccgtcgtgcacgccaagcccagtggacataggccaccagccaaaacgcagcgaagaacccaaccagcgcgtaaccgagccaccccagatcaacgctggcgatccagcgaccaaatccagatgggatgtgcaccatctgcagcagttcaaacgaaccgatgcccagcgcagtcacagcggaaatactggtcatcacaatgttgtagcgcatctttttgcccggcgtatcaaacgcccagctatacgcgcacaacatcatggtagaatccaccgtgtccatgaggttcataccggaagcaaacaggatgggaagggcgaagataccgcaggccgtagccgtcgtttgactggcagtcacagctgagagcgcgatgaccgtgatctcagtggcggtatcaaatcctaggccgaacacgaacccgatgaagtacatctgccaatcgtggcggatccacttaaagagcggtgctagaatccgcgcaagaaccccacgcgacatcaacaggttttccaactctggctggtccgttgcggcctgcgactgacgacgcatccgtaacagcttgcccagaatcacgaaactactgagggcaataatcagcagaaagacgccggaaacaaccgtcccgatctgaccgccaattgcgtttagcatcgtcagtttctcgcgcgcccagcccagcgagacgcgaacggctaggatcatcaagaacacaacggtcgagtggccgattgagaaataccagccgacaccgtacgccgattcgttttggttcaataaccggcgcaccgtgttatcgatggccgaaatgtggtcggcgtcaaaggcgtggcggagtcccagggtgtaggccaatacgcctaagccaacgaacttaggtgcggactgcgccgccaccaagagcagcccaatgcccagcaggtgcaggacaagggtcagcccatagaacggtatggtctttctcaggcgcatttttttcatcacggcacttcccttcccgatacgcgacctagtcgactaaggctgacttaacgtcggcagtcagactttcgttcatccgacctgacttgaagccttcaaggtcgacagtaacgtagtcaaaaccgaattcttgcaacttgtcgttgatggcaaacatttgggcaactaaatcgttgatttggtcagccatgatctcgatccgggccaacttgttttgaacacgtacccgaacagtggcaaagcctaagctacgcaggtaagcttctgacttcatgacccgttggataccttcaacagtcaattcagtgtcgtattcgaaccgtgatgatacggaacagctggcaaccttgttccagtttgacagaccggcttcacgggccatgtcacgaacgtctgacttgtagatgttagccacttggagcactgaaacagcaccctcttcgtcacgggcacgtaagccgggacgaaaatcgtttttgtcgtccatgatcatgccgtctaaaacaacgtcgcagttgctgttatctttgagttcgttcatcttttggtagaacatctttttcatccagtaccatgagctggcacggttgttcttgatgtcgtcgtttgacaggtagtccaatgtggtgcctaaaacagtggcgcccatttcttgggcaagatccattgccttggtgtattcttcgtcagtgaacaggtcagagttggcaacaacggccaagacgttttccttacccaacgtcttcaaagcggcgtccaacacaacggttgaatcgatcccgccagaaaaggcaactaacaccttgttgtactgtgacagtgctgcggttaatgctaatttctttgctgattccatgtgtaattacttccttttttaaaattaaagtccaagataaaattttgcaaaaatgacggctgctgcggcaccaaagaacggtgcgataccaggcacaagcaacccgtattgccaatcggctgccgccttgttcttcaatggcaggatggcaaaagcgattcgtgggccgaggtcccgcgcttggttcatggcgaacccagttgggcccccaagtcccatcccaatggcccagaccagcagtccgatgccaattggcatgatgccgggtgtcttgatggtcacgatgaccatgatcgccgtcaggaaaatgaaggtgtcaaagaattcgacgaagaagttccgtggcaggttccggacaccaggacccgttgagaaaatgtttcggatcgtcactgggtcgatattgtcgtaggagtgcttaaattggtcggcgtacatgatgtacacaatgacggcgccaatgaccccaccagccagttcaaaaatcgagacttcaatgaaccggctaaagctcatgttccccagtaagaattgcgcaaatgccatggctgggttcaggcagatggttggaaaaatgaataaaacgattgagatgccaaatgcccatgttgtgatggcaaataaatgccctgaaccgtggtacttcgtgtcatttaagacggtgtcggcgtgaaccccgaccccaaagacaatcatgagggcagtccccattaattccgcaaataattgatgcatgttagttcatcccatcttctttgtcgtatgctagcaacgctgcgcgacggaccgcgtcaagactgacgtggtggctgtcggcaagggctgctgcactatcgtattcaacagttactttttgttgtccgttaaacgtgccaattttaagggtcacctcaccgaatgcggtggtgacggtcttaaacgtccgcggtaatgttgcccgcttcatgttggcccaacgcacgccaaacgtggtggtgtgggtcatcagcaggtcaaccatggcctgcagtttagcactggtcgtgatcaccgtgacctggtaagccggccggttcttcttcatgaagatcggcgtaaagtaggcgtcgtaagccccggcagtcattaatctctcaatggcatacccgagcccctcgcctgactggtcgtccacgttggcgtggatctccacgatttcatcgctggtggagtgcacttctttttggctggccattggtgtcagcagcagtccgcgcaacccatttaaatgcccagtgtcacgggtaccgaaaccgtagccgaccttttgcacctgcatatcgtccggaatcgggccaaatgaatcgaaggccaatttggcgattgcaaacccagtcggcgtcaccaattccgtgtgaatgtcagtccgttgccgaacgggcacttcactattttggcgcattttcatcacagcgggtacgggtactggcatggtcccgtgggccacttcaatggtcccagaaccgtcaaccagcgtcccgctgataatcccgtcaatgcccatcatctcaaggccgacgaagaaaccgacgatgtctacgatggaatccaacgcaccgacttcgtggaagtggatctcatcgagtgacaattgatgaacgtgagcttccgcctgcgcaatctcgttaaagacgcccagtgcttgaatcttcaccgactggctcaggttagagttattgatgatcgtttcgatctcctgcaggttgcgcccgtggtgatggtggtgatgatgcagcgtggcggccaggtcatcgtggtggtgatcatgctcagccaaatgatcatgatggtgatcgtgttcagcaagctggtcgtcatcgtgatggtggtgatcgtgggcctcaacctcctgcgcggtgagactctcatccgcgtggtggtgcgcatcatccagcacaacgccgaacagctgcccgccgattgcggaccgggtcgtcttctccagcgtcaggtgataaccggacacgtttaatttttcaagttccgcctgaaactggtcaaagtccagccccaggtcgaacaggacacccagcatcatgttgccgctaagccctgaaaaggggtctaaatataagtaagccattacttgttctccgttaaataattgatctgactggcactgtagccggcgccgaacccgttgtcgatgttgaccacggtgatgccagatgcacaggaattcaacatggtcaacagggcggacatgccgccaaaactggaaccgtagccgacactggtgggcacggcgatgaccggtttgtcaacgagaccgccaacgacagaggctaaggctccttccatgccggcgatgacgatgacgacctgggcgtcacggataacgtcaaggcgcgcaaatagccggtggatgccggcaacaccaacgtcgtagacccgggaaacgacattcccaaacgcctcagccgtcagcgcggcctcttcagccaccttcagatccgatgtcccggctgtgaccaccgcaattttgtgggtggtcggcgtcagagcagtctgttgccacagcatcacctgagcatcgtcacggtaagtcatgtcagggtatgcttgaagcacctgatccgccttctgctgtgacacgcgggtcactaaaatattcacttttgtggtcagcattgcctgaatgatgccgatgatctgctcggccgtcttcccttcgccatagatgacttcgggatagccggtgcggcgctgacggtcggtgtcgaccttggcgtagtcgagatccataaaaccgggatcatcgagctgtgccatggcagcgtcaactgacagttggtggtccgcgacctgttttaagagcgcggccatgttgttttttgccatgttcagattagtcctttgtcttgacgatgacgcctaatccatcagggataacagttaccttagctttttcgccttcacgcttgtaggccatttccatggcttcttccaagctcgatgccaattccatgtgcatgtcggtcacaaggtttggttgcaccagatctgagaccataatgacgtggtggttgaccaggattcgagccaaaatttgggcggtccactggtcaggaatggtttccaaacgtggcgtgttgacggcttggtctaagaagaccttaggatcatcaacgtcagctaagttatggtagaaaccttcaccaccgtgaccatcacggcaaccagaaaccatgatgatggtcccgttgtccttgttggtggcttcggcagcggtcatgcccttaacggcttggtagatgttttggtccagggggtagccaccgttggttgagatcgaaatgtcagaaggaatggcatcgacctgtgataaggaagcgacaaagtcagtccccttcttgtgggcgttttccaaatcaccggcaaatgaggcgatgatcttcttatcttcatccaacacaacgttgaggatgaattgtaaatgaacggccttggcagcgaacaccatgtccttgtgaatcatgttgtggtgcaggtccccggtccggctgtgcttgtcggcaacgaattcaccggagtggttggccatgatagttttgtatgaggcgatcccaggcaaaacggacttccggccgccagagaatccagcgaagaagtgggattcaatgaagccttcggagatcaacaggtcagcttcaacagcgaccttgtttaaaatgaggtccccgcctgaaggcaacttgccgatgttgaccatgtcttcatctttttgggagtagtgcatgacaatttcttcattatcaacgatttcttgcccgtacttgttgatcaattcttcgcgggtcgatggccggtgaaatccagtggccaccaaaatccgaacacgagcgtctggtgcgacagaacgaatccgacgtaacaaaattggggtgatgatgtgtgatgggactggccgggtgtgatcggaagaaatgatgacaatgttcttcttacccttggctaattcctccaattttggggagtcgatcgggttatcgagcgagcgttccacagtctcaatttctgaaatgggattctcgtagttagcagcttgtgaaactaatttcccagcaaagttctcatctgggatgtgtgccgtgatctttttcttatcatacggcaaagtaatatcaatcatgtttgtcaatctatcctttctctcgaagctaagcactatcatattcttctcagttttcaaaaatactctcattgttgcgttgctttcagcgtcaaaaataagcgtatgatttgttacataaggaaaaattaacttcacaatgactggaagtgtgctaaactcaaataggtatgatttaggacatcaattaaattgggcttgtaaaatcgtttccacccttctaaggatctgaaaaaacacatggttatgaaccgaactgagtatctattaaaccgaatggaggccgcccacgcccccgtcattacaaaaaaacgccacacctatttgacctaccatggccttgcagagacgaacacttacattttaaagcgcgggatcgttaagaactccatcattcttcaggatgggcgtgagttcaacttgtcgtacatcgcaaagccagatgtcattagtctattacgagatgaaatttcaaaggatacggaccagcccttcaacgtccgcatcgagtcggacaccgctgagttctataagatcgaccgcgtcaccttctggcagatggtcaataaggatgacgagttaaacaactatgtcaaggaatactaccgcacgaaattgtccgagaacatcttacgttgccagcaaatgatcatgggcagcaagcacgacgtggtctgcacgttcatgaaccagctggtcggcctgttcggtaaacgcctaccagaacaccaaggcatcctgattgacttcgtggtaaccaacctagatatcgcaggcttctgcggcatcaactcccgctcgtcagtgaccagaattttgagtgacctgcgtgctgaggggattattgatattgtggatcataagtttgtggttaagaatattaattttttgagggattatgtgccgatgtagccagagcgcggagcaaggcggtttaggggcggtgtgtaagggactctagccgaaaagtccggtcctgactttttggtcggagtcccttacacgttagccccgtgccttgcggagcgcgtttagtctatgtaggatatatgaactatctcagatttaagcaaatgtgtgccgatgtatagagtgtggaaggaagcggttaagaggtggagcctaagtaactttgggcagaaaatcccggttttggatttttttgcccgaagttgcttaggtgcggtactgtaccctgtcaagttgacacattaaataataaaaactagttggccttgccgaagcggtattctgctgcggtaaggtcatttcttttgccggcgaatttacaattgaaatgcaacacaaagtaaaaaaataaacccataccgggtagaatatgtttaacgaccaaatcaaacaattcgaggtatccggtatgagctataaacatcttactcctatcaacgaatcaccactatggtaatccatcaacaagatttagtgtagagcctcaaaaactagccaccggggtgaggtggctagtgaagtaatggaaagactgtctgccgttgcgtttggacagctaagctaattttgtttacctgacgaattactttcgtgtactaaggagatggcaaagcgccattgctaaaccgacaactagtctttatgaaatttaatgggttgatgtgatgtggggtgagtattgttactacaaattgttgataacaaacgttgacgagtgattcttctcgattgattaggcaacggtacttgaatccttccacgccttcattataatgaaagcgctttctaagttcaagtaacaactaatttttttcggtctcctttttgcgccccgctaagaagtagtaaccaacgaagaggcaggcaaagaggaccattgaaatgatcaaggaaaccctggttgctggcacgatgaagaggacaattaaaacaaagataaagaagataatcgtcacccagctagtgattgggtaaccaggcatcgaaaagccggcgattccctctgggtgctgcttacggtaggcaatgtggcaccacaagataatcagccaaacgaagacgaagttgatcgtcgaaaccccggaaatgatgttaaagatcccggcgggcatgacgtagtttaagatcacgaccacaaacaggattaaagacgagaaggtcagggccttgttgggcaccgccttattggataggtcggcaaacttctccggagcgttaccaccggttgctagtgcgtacagggagcggctggtggagaagatggcggagttggtggctgacatggcagcggttaaaaccacgaagtttaagatggcggccgccgacgtcaccccaatcccggtgaagacctgaacgaaggggctcgaagtcgtggtgatcttgttccacgggtagacggccatgatggcgatcattgacccgatgtaaaagagcccgatccggattggcaaggtgttaatcgccttggggatgtcggtgttgggatcgcgggtttccccagcggtcagccccaccatttcgatccccacgaaggcaaagaccaccatttgaaaggacatcaagaaaccgtacgccccggttgggaacagccccccgtggttaaccaggttggcaaaggaggcgtagccggtgtgggtcttagtgtggaagagaaccatagctaagccgacgacgatcaaggcaataatggcgacgactttaatcgtcgaaaaccagctttctaactcgccgaataacccgacgttgaccatattaaccagcatcaataaggcgacgattaccagcggccccacccattgtggcaggttggggaaccagtatttgaggtaaatcccggtcgccgttaaatcggccattgccagcgataaccagcaagaccagtacgtccacccggcgataaattccatccggtcacccaagtactccttgaccgaatcgataaaggagtgcttggacgggtcggccaagagcaattccccgagcgcccgcatcatgaagaaacaaaagatccccacgatcaggtaggtcaaaataatcgccggccccgcggcccgaatggcactcccggaaccgaggaatagcccggtcccgatggcgcccccaatggcgatcatcgtaatgtggcggctctttaacgagcgtgacagctttggttgcgtttcagtttgcttatccattctctctatcctcctgcgtgtgatttgggggaaacctggtgataaaaaaagacgcccctggtaattaataccagggacgtcatcacacgcggttccacccatcttcgtagactggtcgtctacctctcggtcaatataggaaccaccctttttgtacgcgcacatgccattcggtttgaccgactttgcagcttccgccggctctcttcgctaacctctaattaaaatttaatctctattataaccgtcgctgacgaaatgtcaaccgatatacaataaaagtgaccggaagaaaattttcttccagccacttccttaattacacatttaagaccttgtccaagaagctcttggtgtcagggtgttgcgggtgatcaaagatctcttccggcgtcccttgttcgcggatcacaccatcatggaagaataccacgcgatcggccacccgcttggcaaagcccatttcgtgggtcacgacgatcatcgtcatcccctgcttagccaaggtttgcataacctccagcacgtcccccaccatttctgggtccagcgcactggttggttcgtcaaagagcatcacgtccggcttcatcgccagggcccgggcaattgccacccgctgcttttctcccccggacagcgtcgtcggataaacgtcggccttgtcctttaagcccacgacgtccaagtacttgagggcggcttcgtccgcctcttctttggtcatcttcttgagctgggtaggggccagcgtgatgttttgcttaacagtcatgttcgggaaaaggttaaattgttggaacaccatcccgatgttttggcgcaccaagtcgatattggtatgcttgtcggcaatgtcgtaaccatcgatgtaaacgtggccggagttggtttcttccaaccggttcaagcaccgcaagaaggtactcttccccgatccggacggcccgatcacgcagaccacttcgtttggtaacacgttgaggctaatgccctttaagacctcgttattgccatagcccttatggaggtccactacttgaactttgtatttcttatccataatttaagccatctttctttgtacgtagtttgaaagccaagtcaacagggtgatgatgatgatgtagatcaccccaatgattaaccatatcttgaacccttccatgttccgggcgatgatgaccgtcccggtttgggtcagttccatgaccccgattgccgaaaggattgacgtgtcctttaaggtgatgatcaattggttaaccaaggacggcaccatgatcttgatcccttgtggcatgatcaccttcactaaggtcttgtagtacggtagccccagtgaacgagcggcttcccactgcccgcggtcaacggcttggaaaccacccttaacgatcgccccgacgtaggccccttcgtcaagcatcagggtcaaaattccggcggtaaagagcggaatcttgtgtccgattacggacggcatcccgatgtaaatgaagaaggccaagacgatcattggcatcccccggaagatgtagatgatgacagaagaaatcgacgagaagatcttcctgtcggagatccccatcaccccgaggatgcccccgaacaagagggctaaggctaccccgacgacggtcaggagcagggtttcacccagcccgcttaagagggcgtccttgttggacttgatcaggccccaaacgctccggtcgctgtccgtttcggtcttggcagcgtcacccttagtgtacttgttgatgatcttttgcatccgacccgtttccttgagccaggtgatcccgtcgtttaacttgttgagcagttcttggttttgccccttcttaacccccatggccactggcgtcgagttaatttccttggtgacgatcttaagcttgatcccgtttcggatcccgtattgcagaaccgggccatcatcgaaggtggccgcggcgttgccgttcatcacgtcgttccacatcgtgttggaggtgttgaagtacttcaccttaaagccgtacttgtccttaaccgagttagcgtaaatggcgctggcggtcccggacttaacgtcgacggtcttaccctttaactggctgagcttggtgatcttactgttttccggcaccgccattacgaccccgtcagtgtagtaggacttagagaagtcgatcttggccttccgttcgtcggtaaccgacatcccacccatgctagcatcgatttgaccagcttccaacgccgttaaggtggcgttaaaagacatgatctttaagttgtacttaaatccttcgtgcttggcgatttcgcgcagcatttcaatttcaatcccggggtttttcccgttgtaggtcccgtttttatcttgaatttcgaagggttcgaatgtgtcgaccgtcccgatcgtgtaggtcttttcggcgtgtgcaggttcactaccgaccaccatcaatccgagtacgactccggcgactacggccagactagttagcccacgtttgagccaatgcttcatccttaccactcccttacaatatcattagattttaaagttactatttattactttatcacttgtaaaccttaacgaaaagtaaagttgcccaaaaccgtcaattaaaaggttgtaatcatttccttagagtaaatattaagctcaactccgctaaaaacttaattttgtaaagtctaaatctggttgacaccggttagttcccgtggtaaattcacaattagttacattgtgatgggaacccagtagaagccgtcccgctggccaagggagctaatggtggttgaaaattagcgcacgggcggtcttcgaattacactcccatcaatttttaatctaatccgcgttaaatgaggtgcgtttttacgcataaaaatgggtggtaccacggctgagtcgtccctgtgctaaggcataggggcgctcttttttcatttaaaacggaaacgccattactttggaggaccattatgaacattatcgatgaattgaagtggcgcggggccttaaaccaagccaccgacgaagaaggcttacgggaactgaccgaagaaaagaagattgccctgtactgtgggaccgacccgtccggtgacagtctacacatcggccacttaattcccttcatgatgctcaagcggttccaattagccggtcacaagccggtgatcctgattggggaagggaccggggccatcggggatccctccgggcgcaagacggaacgggacctggaaacgatgtccaagctagaacaaaacgtccaatccctgaccaagcaaatgatccgcttgttcgggaccgaaaacttcacgatcgttaacaactacgactggctgtccaagttcaccatgatcgacttcttgcgcgactacgggaagctcttcaacttaaacacgatgctcaacaaggaagttgtcgcctcccgcctggacgccgggatctcctttaccgaatttacctaccaaatcctacaagcgatcgacttcttgcacctctaccgccacaacgacgtccaactccaaatcggggggtccgaccagtgggggaacattacgtcggggatcgacctgattcacaaggttgaaggtagcgacaccaaggtcttcggggtgacgatcccgctgatgctcaaggccgacgggaccaagttcggtaagaccgccgggggagccgtttggcttgatcccgaaaagacctcgccgtacgaattctaccaattctggttgaaccaagatgaccgcgacgttgtgaagtacctcaagtacttcaccttcttatcccaagaagaaatcgccggcttagaagaaaaggtccagaccgaaccgtggaagcgtgaagcacaacgccgcttagcccaggaagtgaccaccttcgttcacggccaagccgctaccgatcaggccgaaaagatctcggccatcctcttctccggtaacatccaagacctgacgacggccgaagttgaacaggcctttgccggcaccccgagcgtcgaggtcagtgccgaaccggccaacatcgtcgactggctggtcgacactaagatcgaaccttccaagcgccaggcccgcgaagacgtcaagaacggcgccattcgcgttaacggcgagaaggtgactgaccttgaggccacccttgaccccaccgctaagtttgacggtaagtacgtggtcatccggcgcggtaagaagaactacaccctggcaaaagtccacgcctaggtcttttcaagaacctaagcagggcttacaatagtcaataatcagaccgggaaaacagtagaaggtgctcaaacagagacggctgaccttggtgaaacagccggcgccccttcgaattggagccgcggtcaacattgcaatacaccaataagtgatggggatttccccgtaagataggtggcaccgcggtcattcgtcctatcctcctcggggggtggggcgttttttattggcgccaccacggaaaggaatttaatatgaaaaagaaagttattttaaccggtgaccgccccaccggcaaactccacatcgggcattacgttggttccctgcgcgaacgggtcaagatgcaagaaagcggcgaatacgatcccttcatcatgatcgccgaccaacaagccctaaccgacaacgcccgcgaccccgaaaagatccgccgctccctgaccgaagtggccctcgactacctggcggtgggcctggacccggccaagtcgaccctcttcgtgcaatcccagattccggccctggccgaactgaacttgtactacctcaacctggtgaccgtttcccgcttggaacgtaacccgaccgttaaggccgaaatccaacaaaagaactttaaccgctcgatcccggccggtttcttcacctacccggtcagccaaaccgccgacattaccgcctttaaggccaacctggtgccggttggtgacgaccaagaaccgatgctggaacaggcccgcgaaatcgtccggacctttaactccatctacggcgaagtgctggtcgaaccagaaggggtcttcccgccaaaggggcagggccggatccctggtttggacggtaacgccaagatgagcaagtcactgggcaacgccatctacttatccgatgacgaagacaccctaaagaaaaaggtcatgtcgatgtacactgacccgaaccacattcacgtcgaagacccgggccaagtcgaaggcaacgtcgttttcacctacctagacatcttcgacaaggacaccgctaaggtccaagagctaaaggaccactaccgccacggtggcctgggggacgtcaagattaagcgttacctgatggaagtccttaacgccgagttagccccgatccgacaacggcgcgccgaattcgccaaggacctccccaccgtcatggacatattaaaggccggcagcgaccgggccaaccaagtcgccgcccagaccctggatgaagtcaaggatgcgatggggttaaactacttcaagtaggatttattgcccgggaaatatgggtaaatcaaaataaagctccggcactgctgtaaggcggtgctggagctttttaatacgaaaaaaaccacccgcaaactgcgaatggctttgaaaagtgacccgtacgggattcgaacccatgataccaccgtgaaagggtggtgtcttaaccacttgaccaacgggtcatttaaggacggatatgatcttatcaactattcgcccaaaaggcaagtaaaatggtcgaattaatttaaaaaataaccgccttagcccggcaaagctagcggttatttaattaatattagccggaaatcccgtgactttagtcatgggatggataggccactattgagcacctttatggggctttttgtttgtttctgtaaggattgaaaaagatgacaattcagaagaagccggtatgcttaagcttgtgaaatgataaattcgcagaatttaatttacaccaacattttggacttgaccgtgattaggggcactttggggtgattatctgctttcaagtttcagtttttatttcttaaagtgacaacttttaaggctattgtacgggcgggggatttttcattactctttttaatgtacatcatcaagtacacatgctatagtgagtgtacggaatgatgtacgtaaagaacgagggaggcgggattggatggaccaaattgtaaccccaacgcaagcacggaaagatttattcaaaataatcaaaaggatcaatgaaaataatgagccggttgtgattaagccgaccaaggcggatgaaaagagcgttgtcgtcattggtgaagatgactggaaagcaatccaagaaacgttatttttggttaatcacggtgttgacaagcaaattaaagaacgggaaaacgagccgctcgacgactttgatgatgtttggggtcaactatgagttacgcgatcaaacttaagcggagcgctaataaagatctcaagaaaattaaggggtcatatttagaaaaaagcttcttgcaaataattgagcagctccgtaaagaccccttggcacccaaccaaggctttgaaaaattagtaccgccaattaagggcttttactcccggcggattaacattcagcaccgactcgtctataaggttgatcaagacacgcaaactgtgatcatctattctgcgtggtcacataataggtagtagctaatttaattaaccgcccggcgcccagctgggattgccaacaagaaaggggctggaagatcaatttcttccagcccctttggcgtctataaagataacggtgcgattcgtatttagcttggcccacggcctgcccaatggttgggtcgcacttccataacgtggaaaatgaccacagacctagtgtctaagtacgggcgaagaacggtgccaagacaccaaccttcgccctagcttagtcatacggtctgtctaggaggtcagttcccactcactgataacgtgctccccaaccgcaggcctagtggctaagtctgggtgaagaacgatgcgtgccgcatcaaccttccccctatccttagcccacggcctgccttatggttgggtcgcacttcccttaacttagataatgtccaagtgcaactggttgtccttaaccagaccaaacttcttcatgacttggaagaggaagacagagatcacggccggcataacgattccccacagcatgtaggcaacaaactggttggtgccttggccccagaagtagatcggggcgatgaaggagttcagccctaatcccccaaccgtgtaggcggcgcgtaggccagaaagggtggtggccagtggggcacaaacgatggcggcgactaaggccggaaccatttgccatgggttcaagatcaggttggggaattgaacctttggcgttacgacgaactgagcaatgttagctcccggcgtgttttggcgccaagacatggccgtgtaaccaacgaattgagcggtcgtcccaatggcagcggcggccgcggagatcgggtccaaagtcaaggcgacggccagggcggccgaggaagccggggtcatcaagaagagggcccaaacggcggagatgaccatcgaaccaaggacggtgttaaccttgatggaggcagcgatccaagcactagtggcggtcaaagcgggcgtcactacggaagccaagccgaagccgacgaaggtgccgacgaaggagaccaccattggaaccaagaccatgtccagcggtgtcttaccggacagccacttccctaagagggccgccagcagggccgcggccacggcggaaacgggttgtcccgtggagaagacggcgttaccaacgaccagtgggtgagcagcgccccccaccgattgcatggccgtcgcggtgctggccgtttgcacgaaggaaacggcgttggcggccacggtggctgaaatgatggtggagaaggtaaccagggtggtgacctccagttgggaggcaactgccaatcccagggccggggcgagcagggcttgggccagggtgccggcttcaaagagcggttgccagtggacgaacccagcgacggtttgcattaacagccccatccccagggtaaccaggatggcgttggcaatcgcggctgagagattgtaggcgtaatcgcggacggttttcttggcttcttgaacgtcaacgcggttcatggcgtttgtagttgctgcttgttccatgttgttcatctcctaatcttaacggtccaatttcaaataaaaagacccggggctaattaccaccccgggtctcacgattttttaatcgaagatagctaaaccttacccacttagtcgtgcagggtccccctcacgaatccgtgcgtgtagtttttggccgggatgttcacttatgctaggcgtaataatgactagaattaggctaattagtaggctaataataatgactagcatggtggacacccctttcggtaaaaatctgttatctcttaacgttttctaatcttaacatcattttttaattttacaaccagtttttgaaaataaaattaagttttatccaggaggggcttgcagaaattaggtcacaccggcttttgatggcgtgtgaactactcggccataaatgaccgagtagttcacatttagttgatagccatttccttagcactcttcgcctttacaaagcccatcaaaacggccaggatggtcacgataaacgggaagaaggcaaatgggacgaaggcgagtgggttgacctggagggtagcggcgatgaagaccccggaaacactccacggcacgatggcgttgacggccgccccaacgtcgtttaggacccgggtcatcagttcacgggggaggtggtggtgatcaaaggcttccttgaaagattcccccggtaagatgatggctaagtagtgttcacccactaagaggttgaccccgatacaagtcagggcggtggccatggttaaaccacccagtcccttgacgcttgcttcgaccttgtcgacgatcgccccaatgatgtggaacttaatcaacaagccccccagtgatagggcgaagatgattaaggacagcgaggttaacatgctactgataccccccttggacaagaggaggttgatcgtcttgttaggggtgtgggcaacgtagccgttcatgatcaggtgggtgaccttggtgatcgtggtggtggggtcgtagagccagcccaaggcgatcgcaaagagggcacccagccccagcgacgggatcgccgggacccgcaggatcgctaggatgatcatgaacaagaccggcaagagggtgattggggagatccaaaaaccggccttcagccccgccatcatgacgtgaattgagtgcaggctagcggtcttggcgctcatcccgaccaccgtgaagatcaccagtgagatgatccaggccggcaaatcggtccaggccagcgagcggatgtgcttgtagatgtctaattccccggtggtggcggcgaggttcgtcgtcccagaaagcggagaaacgttggagccacaaaaggccccggaaacaattgccccggccgttagcggcaggctaatgtgtaaagtggcggagatcccaataaaggcgatccccatcgttgagatactggtaaacgaagacccacaggcgatcccaacgagggtgcaaacgatgaagacggtggggaggaagaacttaaccgagatgatcttaaagccaaagtacatgatcgtcgggattgtacccgagaagatccaggtggcgatcaagaccccgatcgtttggaagatcaccagggggtcgacgccggcccgtagcccggtgcgcatcccgtcgatgatcgtgtcccacttaaagccccgtagacggccgtaaagcattaagataacaaaggcgatcagcagcggcgcctggggttcttgtttttcgacgatgatcaaaaagcccagcaggcccaagataacgactaggaccaagatacattcggtcaggctgaaggtcggttcaacccgttctttaaattttttcatgataattcctctttttcactattagtctcaaagcgactggcaacaatcgttttgaaataatagccctttccaccgttcttgactggcatcgttttcacctccttaaaataaaaacgccccctgcctgatcaacaggcaagggacgattttcaccgtggtaccacccagctttgtgcattgcacctcaaatggactatcgcgccgtgcgtgagtcaccttggttggagtgtaattcgtgatcgcgttgtgggttaacttacagcgccgttaactctcttagccagggagcggatcactactggggttccggtgaatcattagaatcttttaatgttgaatgtattaaaacacgggcgcccattccttgtcaacaagaaaatttaagagttaatgagcggtgaagcgtagtgacaggcaggtcaggccgccatcgattttttcaaattcgctcatcgccgcttcaaagaccgggaagccgtggtcctccaacaattgtttaaccaccgggaagcccgccggcatgatgacgccgttaccggtgttgatgcagttgacggcgtaagcttcttcggcagggacgaccagttgggtgaagttagcaaaggcggggtggttaacgaactcaccggttaccaggagcttgccatcgcccagataagtcgtcccggttttgaggtgcaagaagtcgtggacggggaccgcaagcgccgggtggttaaactgagcggcgattgctttaaactgttcgaacccttcccggttggttcgggccgacaagccgacgtaataagtcccgtcgacttccatcacgtcgccgccctccaggtgcccgggggcggtaatctcaaagatgtggtcctgggaataaaagtgttcgagggctagccggatgaaaccacgttccggggtccggctggcgcgggccgggttggtgattacggcaaagtcagcggcgaccaccgccgggtcctccacaaaacaggaatcggggaaggcttctaaggggtctaaaacggtgacggtcaccccgcggtcctttaacagggcaacgtaggcttggtgctgagcgagggctgtggggtagtcggtttgccccaggttggcgtagtcatcgatcccgtcgatcaccgagtggccgggggtgcggacaagggcgttagaaaagagcattgcgattcctccttcttcgattataatcaacttaatctaattttaattttatcacaattattgtagtaaaggaggatgctgatgaaccaagcagaagtgtatcaatacctaactgagcacgggatcgactacgaggtgaccaaccacccggcggtctttaatatggcggcggtggccgactttccgatgccccaccccgaggccaacgctaaaaacctctttgtccgcgatgacaagcaccgccattactacctagtcacggtcaaaggggaaaagcgggtcgacttaaaggccttaagcgcccaggaggggacccggcggttgagtttcgcctccgagcaagacttacaaaagtacctcgacttgacaccgggctcggtgacgccgctgggggttttaaatgatgagcagcgcaaggttgaggtgatgattgaccaggaattggccgcgggattggtggcggcccaccccaacgttaacacggcgacggtgtggctaaagaccagcgatttggtgcagctgttggccgaccacggcaaccaggtgaagctagtccacattccgattagaaatgctgattaaaggggtgcaccctttcaattcgttatttaaaaatttataatgaaggaaaggagggtgattttgatgaatgaaccagttttcgattcctacttttacgatgagcaagccttcaaccttcacgatgcggcctacaagccactgaagcaggctcaagcacccgcgacgcccctcaacattccgcccctgttaaccccagacaaggtggacggcgacgacgtgtactacaccgttaccgcccaggcgggggcaacccagctattgccgggggaaaagaccaagacctggggctttaacgcttcaatgctggggcagacggtggtctttgagcgcggcaagacttaccacatgcacctggtcaaccacctaccggaagtgacgaccttccactggcacggactagagattcccgggccaattgaagacggcggctgccacgccccggtttacccgggcgaggcccgcgacgtgacctttaagatcattcagccggccgccaccgcctggctccacgcccacccctgcccggaaacggcctaccaggtttggcagggactggcgacgatggcgatcattcacgaccaagaagaagctagtttgcccctgccgcacacttacggagttgatgacctgccgttgatcctgcaggaccgcaacttccacgcgggcaaccagtttgattaccgggccgattacgaccctgatggcgtccagggtgacacggcggtgattaacgccaccgtcaatccttactttgacgtcaccacccagcgcctgcggttgcgaattttaaacggctctaaccgccgcgagtaccggctccacttctcggacgacttaaccttcacccaaattggctcggacctgagctttttgccccacccggtcaagttaaagaagctgatgactacctgtgccgagcgccaggagatcgtggtcgactttgccggctaccagccgggcgacacggttaccctgtactccgacgacagtccgctggtcgagttccggatccacgagtttacgccggcaggagaggagttgcccaccaccctgaccaagattgattacccgaccccagacccgagcctacccgtcaagcaggtggtgatgtccgggatggacgagacggtgatgattgacggcaagaagttccagatggaccggatcgattacacgatgccgatgggcaagtgccagctttgggacattaccaacaccaacgacatgaacggtgggatgattcaccccttccacatgcacggctgcgcctttgagatcgtctcccgtaacggccaggaaccctacccgtttgaacacggacttaacgacaccgtcgccgttaacccgggcgaacacgtcatcatcaaggtctacttccaagtgccgggggtctttatgtaccattgtcacattatcgaacacgaagatggcgggatgatggcccaactaaaggttgtcgacccggccgccccggaccgggagtaccacttgctcaaccatatgaccctgatggaggcctttgccaaggagcggggtgtcacgatggatgaactctggcttggcgggatggactcctacaagaagatggggatgcacatgtagcccttaattagcgaaaaagcggtcgggtgaccccaccgctttttttattttggagcagaaaaaaggcggcgcccggtgcaagcaccggccgccgcctaaaatgacccatcaacaggatttgacaaagagccaaaacaaggggctgggagaaaactgtgttttctcccagccccttgttgtattcccgaatgttagacataaaacgtggtaaataaccgcaggcctagtgcctaagcaggccgaagaacagtgcattctgcactaaccgttcgtcctagcttagtcatacgacctgccgagaaggttatttcccactctccttgttatcttttcgaaggttacttcccaccctcttgcgattcagctttgacgtcgttaacactcacccgttggtggctgtgcttgagctgactgagcaccccttctcttccctggttgacggtaaactcatcgaccgccccgcagtgggtacaggccactagaatctggtactgttgcgagtcgtcgttgttggtggcctcccagttgcgctcggcgatcaccagtggctggcggtgacacttgtagcagggtgccgctagtaggcaatcctccctaaaggggtcgccgaccttgccgaccatcccccagcggtcctcgccatgaacttcatcgtaattttggtaaaacaaacgctcaccccctagtagtattcagcctggcggtgattcttttcaatcatcaaccaggaaactaagccggcaccaaggattgctaacgtacagacgtaaaagaggggctgatagctaaaccgttcgatcaccaggccaccaaataaggggcccagcgccttgccggctgaaccaaaagaattgacgatcccttggtagcgccccttatcttccattgggcacagctggttgaccagggccgggatcgttggaatcgccgttgcctcccccagggttagcacgaccattgagaagacgaaggccccgtagcccttggcaaagggcaggatcaaaaaggacagccctaacatggcggtgccaaagtacaagtaaaggtgatcgttgttcatccgccggtttaaccagttaatcgccatctgcaagaccacgatcaagagcccgttgatcgtccacaacagcgagtagctagtcatggaaaccccgtgaccggtaatgtaaaccgacatgttggatgaccattgcgagtacatcatccagatcaccaacagggcgccgctcattgtccaaatcagctgggaattggcccggggcaacttaaccagtttttcttcgtgctggggccgtttgatgacggcaatttggtagaacttgatcaccactaaggaaaaggcggcgtaaatgaccacggtcaccaagaacagtggccccacgttatcgtgggcatactggtaaagcgggccgacaatcgtggtcccaaagaccatccccaagttattggcaaagtagagcatgttaaaaacgaagcgcccatcccgactgcgcatccgggcaccgtaggagttgtgcatcgtcatcaaccacccgttgacgatcccaatcagggcgagcatgatcgggtaggttggccagtcgtttttaaaaaccaacacccccatgaagattaccgccgccacgatccccccgagggttagccgttggggcgagtacttgtcaaataaccgcccaccgacgtaggaaccgatcacgttagttccggaataaaagaggagcacaattccagaaaccgtcagtgactggtgtagttgatcgtggatgtagaccgtcgtcagcggccaaataaagctgttcccaacgttaaccaaaaagctaccgagcaacagccaacgaaacttaatttctgtttgcatttcctcacctagtttccttaattttagacaacacaaaagtaccgtaagcatccctaaaggacgttacggtaacttttacttagttattgtggcccctgccccggcgtgaaatcgaccgaggcaaacttgttgtaggccttattaaagagtagtttgacggttccccgcggaccactccggttcttttcaatgatgacttcgacttccgacagcgagttttcggcctcctggtcgcttcccgcttgcggcgccccgtcctcttgttgttcgcgggtgtagtaatcgtcgcggtataagaaggctacgatgtcggcgtcctgttcgattgacccggattcccggatgtcggacataaccgggcgcttatcttggcgctgttcaaccccccgcgaaagctgcgagagggcgattaccggcaccgataattccttagcgagcttctttagctgccgggagatttcggagacttcttgttgccggttttccgagttgctcccttcgatcagttgcaagtaatcgatcacgatcaaagacaggttcccagtccgcttctttaagcgccggcacttagcccggatttcggggaccttgatcccggcggtgtcgtcgatgtagacgttggtccccgccaggctccccatggccacccaaagtgcgtcccactcatcggtatcgaggttcccggtccgcaggtggttggcgttaatccccccttcggcacacagcatccggttgactaacgactccgcccccatttccaggctgaagatggcgacggttggctggttatccccacggaccgccacgttttgggcgatgtttaaggcaaaggcagtcttccccatcgccggccgggccgccaagatgatcagttcgtcttcgtgtaacccggtcgtcatgttgtctagttgcgggtagccggtccgcagcccggtcacccgggtttgctgcttagagagctcgtaagtgtggttggcggcttcgtgcaccacttcttcgatgttttgcatctccgattggttattgtcctccgccacgtttaaaatcgactgctccgcccggtcgagcatgtcggtgatctcatcggcatcctcgtaaccctcactagcaatcttggtggccgtatcgattaaacgccgcgccgttgctttatcgtgaacgatcttggcgtaaaagccgacgtcagccgccgtaggaaccgccgcggcgagcttggcgaggtactgaattccgcccaccgcctcgagctggttttggcggttgagctccacttgcatggaaacaacatcgatcggcttatcgttgtcatttaaggcaaccatggtcttaaagaggagctggtgctggcgggtgtagaagtcgtcttctttgacgtattccatcgcctcgacaatcgcgtcatcctttaacaggatcgcccccaaaacggcttgctcagcctcaatgttgcgggggggcgtccgactaatttctggacgagtatccatttcccattccttgccctttcactttgacctggtgccaggacgaactacttttcagcaatgtgcacccgcaaggtcgcttcaacatcgtggtgtagcttaaccgggacgttcacgtagcccagggcccgaattggggccgccaattccatcttgcgcttatccagcttgatttggtactgcttttctaaggcggtggcaatttgcttggtcgaaaccgaaccaaacatccggccatccgttccggccttcccggttaactcaacgaccgttttatcgtcttctaagaccttctttaactccttggccgccgctaattcttcggcctcgtgcttttccctggagcgttcctggccggctaattcgctcatggccgccttgttagcttccttggccttcccccgggggatcaagaaattttgggcgtaaccatcaggaacgtttttgatttccccgcgcttaccgcgtcccttgacgtcttcagtaaagataactttcattagtcttcctccgtttcttcttttccgttggggagctgttccccatttaaaagctgctctagttggtctttgacctcagtgaccgtcttgcccgtcacctgggtcgcggcgttggctaagtgacccccaccgcccatctgctccatgattacctggacgttaaagtcccctagcgagcgggccgaaatgcccacgacgtcgttggagcgtctggtaatcacaaaggaggcgtcgatgccgtccatttgcaagagcatatcggccgcctgggccgccgtgaccggatcatacacccggtcgtcttcgcccacgcacagtgccattttgtcattgatgaaggtcaccgccgagatcaagtggttgcgcgctaaaaagctggccgggttttccttcatcagccgttggattaacatcccatcggccccggccgaacgcaggtaggaggccgcatcgtaagtccgggtaccggcgttttggctaaaggacttggtgtcgacccggatccccgtcagcatggcggtggcttccaagcggttgagcccctggctttcccgtggttggtactcaaacatttcggtgattagctcacacgtcgaggaggcgtagggctcgttataaaccaacagcgggttttccgggaattcttcgccccgccggtggtggtcaataatcaccattcggtttgatagtttagcacaaagttccggcgccatcgagattgacaccttggagtggtcaaccatcaccaacaggctcttagcgctcgccttttctagcgcctcggctggtgaaatcacgtggtctttaatcgactggtattcgttaatttcccccatcagacgggcaacgtctgagtggacctgttggttatcaaagactacccaacactggtgctggttcatttcggcaatccgccgaatccccaggcacgcccccagagaatccatgtcgggcttggcatggccgacaacgaagatctggtcggcttggttcatcaattcgcgtagggcctgggcaatcatccgcgcccgtacccgggtccgcttttccatcgggttggtcttccccccgtagaagcgggcttgcccgttttcggcccggacgaccacctggtcccccccacgcccgagggcgaggtcgaggttcttttgggcggtgtcggctagtttaaccaggtcactttgcccgtaggcgatcccaattgatagggtcaccggcgagttttggcgcgacgtgttttggcgaatcttatcgaggacccggaacttatcttcttccaggcggtttaagtccccctcgtgcccaatcagtaggtagttatcatcgtcaattaccttaaccaaaaggtggtggtacttggcccaagcggttagctctgaggtcacgtagttgcgcaagttagaaacttccgagtcgctcatcccctgaactaattcaacgtaattatcgaggtagacgttccccaagaagagccgttcttgccgataacggtcgttgatctgctcgtattcggtcacgtccattaagtaaacggcatgcaagcggtcctggaccaagaactcaaactggcgcgcttgccaggtgacgaccaccgagtgttcgtcgcggcggtgcttattgaccaaggaagctagccgctcatcaaccgcggtcaggtcttggccaaccactaggcgctgatcaaagtagcgggccatgtagggattaatccaacgcaccacctcgttttcatcgagcaagatcatcccaattggcatttcaaagagggcctcttcttgcccctgacggacctggtaagccaagtcgttaacgtaggcttcggtgctcaaagccagccgctgcaagagggctaaggccaccaagaggcaaagcagaataaaggctaaaatgattagccccacccgccagttaaaggcgaagccaacgatgaccgtcaccaacgacatcaacatgacgtaggcaagggttagttgaaagacccgactacccaagagtcgccggacgctttcccggccaaaccaacgctcaaacatttccctgcccccctttaaaagtaacttacggtatctttttaatcatatcatacccccaccggattcgggggcaaataaaaaacgctatcgcaaatcaatgcgataacgttttttattaggaatcctagtcttctgcaacgaatggcagcaagcccatgatccgtgcgcgcttgatggcaatcgtcaagcggcgttggttcttagcactggtcccggtcacccggcgtggtaagatcttaccccgttcggaaatgaaccggcgcagtaaatcagtgtctttgtaatcgatgtattcaatgtggtttgcggcgatgaagtcaaccttacggcgacgacggccaccacgacgttgttgagccatgaaattacctcccttattgtttagtagttgtcttttctttagaagggtaggtcatctgatgaaggcatcccgtcagcgtcgcttgcagaacttgccgaaccagaccccgggtttgcgctgaaggcggcgttgtcgtcaatgttgacggcgccgttatcaccagcagcgggcgtggtgtcgttatccttgctaaatggcaggctatcggcatcaatttgggttgggccttgattaaagacgcctccctggggttggttgaagtttccgttgtacgactggttggcgggagccggtgaccccccgaaattattttgaggagcggccccgaaattgccaccgttaccgtaggcgttattgccaaaggactggccctggttgttaaaaccattgccgccgttgttataacccccaccgttgtaaccaccattaccgttattagcggaccgcggttccaacagggcgaagttttcgaccgttacttccgtccggtaaacccgttgtccctgttggttttcatagttactggtggacagtcggccatcaagaccaacgagtgcacccttgtgggtaaagcgggcaaagttttctgctgacgtacgccagatgacgcagttaatgaagtcagcgtcccgccggcccgtttcccggttcttaaactgccggtcaacggcaattgagaaccgtaaaacgggggttccactttgggtgtaggtcaattccggatcccgtgttagtcgcccagttaatactacacgatttagcatcggctatcgcactcccctcttctactgttaaccgttaagcttagccgcgcttaacgatcatgtgacgcaggatgtcgtcgctgaacttagccaaacgatcgaattcgtttaatgaagcatcgctgtcggcagtcacgtttacgatgtggtaagtaccttcagtgtacttgccgatttggtaagcgaaccgacgcgtgtcccagtcagctgagtcaactacggttgcaccattgtccgccaagatcttgtcgaagcgggctaccagctcgctctttgcagattcttcgatatcaggacgaatgatgtaagtaatttcatatttgcgcgtttccatgaatgttacacctccttatggactctggccccctccgctcttcgaagggaacaaggagagtagacgtcgttacgtatactcacagaatagaatactagcataaattttgatcaatcacaagttaaatctagggtaacaaaagatccggaattgcttccctaatctctaagtacgcaattccggatctttatcacgaaagtcagttgaaaacggtcgctaggcaaagtcggctgggagtcggagttcgaccgtggccgggtcgatcgtgtaggtggccttttcgttgccccgcaccgtcatcaagtagtcggtggcaaagaggattaactccagctggtggccgtcctctaagtggtggtagaccggctgtaagggcagggttagggtgacggtttggtttggttggtagtcgtccggtttggcgaggctgtggcggttttgcaggttaaggtggccgtaggagatgacgtggtagtcgctcggctccttttccaacttgaactcgcgcaggtcatcgtacttccattggtagcccagcggaatggcgtttttgcccaacaggaccgggttcttggtcaagcgccgagcggtcccgcggtcaactaggtacgccgataagaggccgtggtcgaggttggtggccacgtcaacggtcagctgcggggtaccgcgtaaaaccaggtcgccggccattacctcggtggcaaagtgggccgaaaactggccgtcgtcgtttaacagggcggtttgccacttggccgggtgggcgcaccagtcttggtaggtggcgtctgcttggtggtcgttaaaggtgatggggctggctgaagtagcagcgcccttcaccagttggtggtcggccacgtggtaggtaaagttcatccggccgtcccatgcctgagcgacttgccagttgtcttcttggcggttgtcttcgaagagcacccgcggtaagacttgatcggcgtcgtttttgacaccccacagcttatcggccagccacaggttaaccatttcgctaaagtccagggaggcaaaggcattgatgtagatgtgttgaccctggtgaaggatcaggtgggccgggtggtcggccgcctttaagtagtcgtctaaggccttaacgtggaccggcttgacgttggtgtcgtttaggccgtggaccatcatcacggccgccttaatgccggagaagtgggggtggtaattgcgccgggcccaaaagtcgttgtagttaccacttgcccggtcttgggcggcggtcatttgctggaggtacttttggttggtgctttcgatgtgttggtagtcggcggcggacttggtgcggctgaaggtttcggccgctaagacgtcggcgtcttcgccctggaagccgcccggggccaccaccaggccgccctcgcggtagtagtcgtaccaagaggagatggcggcttctgaaatgatcgcatcgagccccgcgaccccggtggtggcgaccgccgtcgccaaggttcccaggtaggaacgcccggtcatcgccacgtgtccgttggaccagtcggcgaccacgctctggttgctggttcggtcgctaaaggccacccggtcgccgtgaagccactcgacgaccgccttcatcgcctcggtttgttccggcgagccacaggtctgcaggccgtcggagtccttggtcccgattccggccgagtaaacgacggcgtagccacgggtggccaggtagtcgtttaaggtgtatgacggggtggccgcaaagcgttcgctcgccggcccgactccctggatgtcgcggtgctgggcgggagtcgggaaggttgcttcggccgggctgtcggcgtcaggatccttgtgggtgaggggcacgttaacgtcgtgggtgatcttttcgccccactcgtcgttggtgccctggttgtacggactcgcggtaaagagaaccgggaccttgagcccctggttggaatcagccgggcggattacctcggccttaactaggtcggccttcccatcgaagtcggtgtcgaggtcggtttggacgtaaacgacctcgtggatgaagcggtgggggttaaaggaggcgactggtttaccgttgaaaaagatcggcttttggctcgccggcaggtggtaggtccaggtgagcatcccctggctggtcagcttgtcgagcaggctgatcccgtttttggtccgggtcaacaagagcaggtagaaggaatcgatcaccgctgcttggtcccattcctcgtggtagtggtggggaaggttgctacgcttgatccccagcagggggtattcgagcgggaagtcgacggcgacttcaaagtcgagcagctggagggccagcaggtagaacacggcgtcggttggttgctcgtcttctttaaaccagtcgtaggcgttggtggttggcgtggccaggaggctctttaaccaggcggcccggccggcgtcactggtggtttccaggtgggttcgcaaaaggaggaccaacaggagctggctggccgagaggttttcgtcgccgtccattagcaggtggagggcctttaattcgtgacggcgggtggcgtcgtcggtttgaatcagtgagaattggttgactttcacaatgaacaccctttcaaaattggcaatttgtatcattataacgcaatcaacagcgagaagtggcaagttagctgtgtagcgggtgaggagcaaaaacaagacagggcaaatgtttagatttgcgtaatatggaagtgcgacccaacctatcaagcaggccgtgggctaaggataggacacaggttatcgcggaacgcggtgttctgtggccggacttagccactaggcctgcggttggggagcacgttatcttaggaagtgcgaccaacctccttgacaggccgtatgactaagctagggcaagggttgccgcctaggtggtgttctgtggccggacttagccactaggcctgcggttggggagcacgttatctgtctaatcttctgaagatacaacaagagcctgagagaaaatcgcgtttcctctcaggctctcttgctgtgttcgttattattatctagctattatggggagcacttaactatttaatcatgcgccaacttgctgtggcggtaaccgtagctaaagtaaagaataatcccaatcacaaaccagatgccggcgccaataaaggtttgaaccgacaagagggcgatcataaccaagcaggcgatcccagacaggattggtaagactgggaaccacggcacttggaagccccccttgttcccgatgtccttgcgcttgcgcagcgggatgatcccaaaggaaacgaaggtgaaggccagcagggtcccaatgttaaccaagctagtcagttggtctaaggaaatcagtccccccatggcggcgatgatgacggccacgatccaaagggcggcttgtggcgtggaactgtgttcatcaagcttgctcaagaactttggcaagagcccgtcacgcccgatggagtaaaccagtcgtgaggaggagtaggtcatcgtcaccatcatggtgaacatcccgaccaaggccccaatcgataagaggtcggcgatccaaccctggttaacggcctttaaggcaaaggcgaccgggttggcaacgtctaacttggtgtacggaaccatcccggttaagaccacggagacccccatgtaaaggatcgtggcgattaccaaggtgccgatgatccccagtggcatgttcttcttagggttcttaacttcggcggccgaggaagaaatggcgtcaaagcctaggaaggcgaagaagacggtcgtcgccccgtgcatcaccccacccatcttaaatggtaagaaggggtggtagttggccggcttgatgaagaacaacccgaccccgatgaagaccaggataatcaagatcttgatcatcacggcgacgttgttgatccgcatcgaagaccgcatcccccgcgataagatcagggtgacgatcaagacgatggccacggcgacgatgttgatgtaggtaccgtgggccggatcaaagggcccagaaagggcggtcgggatgttaatcccaaacgaggcgagtagggaattaaagtaggccgcccacccggttgataccgaggcgaccgccaacatgtattccaaaatcaaggcccagcccaaaacccaaccgatgaactccccaaacacaacgttaccgtaagagtaggcactcccggcaaccggaagggccgaggagaattcggcgtaacacatggctgccaacgcacagacgatggcggccattaaaaaggacagggtcacccccggcccggcatcattggctgctaccgtgccgggaaggataaagatcccggtcccgatcactgccccgatcccgagggtcatcaggtcgaaggcagtcagtgacttcacgaacttttggtcggcccccaaataggtttgaaggctctcctttcgcattatcttcagactcataatcgctaaccacctttgctataatttatgataaagtctacttaaacatgatagagaacatattattaaaagtcaattaaattttaatgaggtgagttttgtggcaattgaagtaaccgccggcgccgtcgtttaccggcatggccaagcaggaatcgagtaccttctcttacaaagcatgaacaagggcaacttctggggttttcccaagggacacgtggaagcgggcgaaagcctagtcgaaacggcgacccgcgaaattaaggaggaaatcagcctccaagtcgccgtcgacaccagcttttcggtttacaccgaatacgacctgcccaacggtaaccgcaagcagatgaccctgtacttagccgactttgatcaagcggccggcctccacttgcaggccgaagaaattaaaaacgccggctggtttgattaccaaacggcgcggcaaaggctgacctacgataacttaaaggacctgcttgaccaggtcaacgcccacctggaggaagcataatggcgggaacaactaagcccgtctttgtgatcaccggggcggccgggagcggcaagacaaccgtggccaagtacctaaaggatacctaccaaatggctaaggtgatcacccacaccacccgtgccccgcggccgggtgaagttgatggagtcgattactactttgaaagccccacgtcaattaaggaccgccacttgctggaacgggtcgagtacgatggccacctctacggctcttcttacgaggggctagaggccggctgggccaagcacccggccgacgtgatcgtcttggataccgccggcgctttgacctaccaccaggccctgggggaccaagcggtggtgatctttttgaccgttagcaatccgcaaaccctagccaagcgaatcaaggagcggggcgaccagttggatgccgtgaagtcacgcctgacgtctaacgagtaccgccgcgatcaatcgctaccggactacttgaaggggattgcccacgtgatcgtcaatgacgactgggcccagaccacgcaaagcctggacgcattagtcgcccaggtcgcccccggggtggtacaatcaagctagtttcaaaaacgtaatcattactaaaaaaggtgggataaccgtggataaactcattacccaagccgaaacgatcatcaaaaatcaccagttgcgtttaaccaagcaacgccgctccctgattgatttgctggttcaccagccggaccactacctagacatcacaatggtggaccgcttgatgcgggacatgtaccccgggatctcccacaacacgatctaccgcaacctcgaggaatttgaggaaattggcctggtggaaatcacccagcggagcaactgcaaggcggtgaagttttcttgtgaggacggggcccaccagcaccaccaccactttatctgtcaaaagtgcggccgggtccaagagattcagatgcctaagtggccgaccaatttttatgaacaacagttgccgggggtccaaatcaccggccactcctttgaactctacggtctttgcgcccagtgcgctaaggaagccgggtcaaaataaattcacgggaatataagaatcttttaaacgttacgaatcgccggctagtgtataatttgtaatgctaatttgtaatgctaaaaagggggatgagaacgaaatgccattaaacacaccaccatttattacaccgtttgccctggtgtcggtggtcctcgccttgggggcgaccaacgtggtggtcaacaagacgaccaacaccaataacggagcggtggtagtttcttcgggttcccgctcgacgtcaacgaactccgggccagccaatagcgcaagtaagccgagcgatgacggcagtgataaggatagtagtcaaacgccggggaacacgaccgattcttcgtcggctaacaagaccaagacggctaacaagaccaacacgactaacaacacgaccaccaataataacgacacgacggctaatgacggcgggagcaccactagctcgtccactaagagcacgggaaccaccaacacccccaattcttcgtcgtcaaccaacaacaccaagaacaataacaccacaacgggggcgaccaccaataacacggcgggaaccaccacgacaaccactaactaaggaggggcgccatgttttcattactggacatgatcaatgggtcgctgggttactttaacctcagcgtcaagattaaaaaccggatttacgtgggcctagccttttttggtgacctgtacctgatctacgtcaccttcatgctcctaaagaaccagtcctggctgcggggctttttgtacttcttggccgtggtgggggtaacttactacctctacttgaacgccgtttattatttcctgggaaaaacctcgcgttttgacttcctgtcgccttggctatctaagttgaccgggacgacgcgtgagacccccgaagaaaaggagcgtcagcggctcgaaaagctggccgccctgcaaaagcaagcaatgggggcgtccaacgggttattcactggtgaagacgtgatccaagccgaggtcgaaatcgattcccgcgagcaagaaaacctccgcaaggtggtcgaccacctagtcgcagaaggggtcctactcgccgactacaacggcctggacgacgacgggattatcacccagtaccaagaaaccggccagccggtcgacgccttaaacgttggccagcagccaccttactttgaactggttcacgatcctttgggccaccgcttggagatttacatggggctaaaccagatggaaaaacggccggtcggccacatcaagcgggtcggcttgaccgacgttcacaccgcccacgaccagtttgacctctacttggccagcctctacgtcaccggggggccacgcaagatcccgggtcggcggggttcaacgatcctgaccgatggcgactttggcctggttgcccaagtggcctaccgggaccgccagggtcaaaatgatagttcaaccacgacgggcgcaccaacccagccgctgggggcccgggaacgggcccggcgccgccattaaccaatcaaaaaaagcaccccgctgaagttagaaaaaaaggcccctgacaatattgcaggtttgtacaccaactggtcgcgtatgatttatgtacgatgggatgaggagccgactgtcttttcaacttgtctgccaaaatttgatgatgacgcaatcaataacgaaattgaacctatgactacttggcgcgtgaaggatcgtcatcataatactaaacatttaagtgatctgggtaagaaaatgtggcgaaattttgggttatatgttcctactgaagctgatactcaaaatgccgatatgaagcctggaatagtcaactggttgagtttattaaaagatggacagctgattccggatgcccattatgtgaatttggcaacggcaaacctaatcagtgatggaaatgctacttctcaactgccggcagcagaaattagcgatgacctttatatcaatgccgatattttatttgatttgcattggacaactaagattgaagatgctattgaatatactcaacaaattattaagtactattggggatttgccaatgggttggctgaattacgaggcataggcgataaaagagactttgcaaacagattgagtgaagatttttataatcgcctaaatgagccatttaataattggctgatagatttggatccgatgcaaccaacgactcctcaaattttaaaatgggaagatgaggttttgcttagaaaggttgacgaacaagtaaatgcagttatggcaacagtatcgcctaaagaaattattggcaagcatgaagataagaataatgaaaaaatgattaaaaatatttttatccttgtcaatatcctccgcgcaagcatcaataagtatcgaaagaaattgaggtagtgagcatatggcaaatgaaatcgcaaaggtaactgcgcagataatatatagtctttataataacggcaatttggataaagcggtcttagcaagtttgcggcatgccgtaacaattaaagatcatcgtgcagaaaatgtttggccgattatgttttcaaaaatggcagcaagtgatatcagcagcgatccacaaggcagagaaacacgacaagagacagctatctatactgcgcttagatgttttgccatttatcagcaaggccttacccagctgagttacgcaagttctaatcaagtaagtgctgaggataaagggcagcaactgtttgtcgctttggctgatctaaggaaaagtcaagacaagcaggcagctcttgatcgacggatacaaaatctcttgtcttcaactaatattgatagtgttgccaagagtattactcagctggttagaattttaaaatctaccgatagaaatttattattagatttttctcagttggcgcaggatctatttttctttcaaatgggttatgagtactcaagaaaggttttcttaaaatggggacgtcagtattattggcaatcagtttcaactaattaatacaaaagataaggaaggaaaaaaccatgaccaaaaatttatatgtagacattcatgtattacaaacggttccagcttcaaacatcaaccgcgatgattcgggggctcctaagacggctctttatggcggagttatgcgagcaagagtatcgtcgcagagttggaaacatgcaatgcgagaagcttttaaaaaagatggcgatggtgcggaatggttactgagtcatcggacgaaaaagggtattcaacttttggctgctaagcttgccgaaaaggataataccctagatttagatgcagcaattaaaaaagcaattgaggttttcaaagtggccggcatcaaagtaaaaaaagatgagaatactactggtgcattgtttttgcttagtgatggccagattgataaattagcagactatgctttacaaaatgattcctatgataaaaaagagcttaaagaggtgtttagtaataaaaattcacttgatttagcactttttggtcggatggttgctgataatcctgaattaaacgttgatgcagcttcgcaagttgctcatgcaatttcaactcacgagatcgtgcccgaatttgactattttactgccttggatgacgaacaagatagtgcaggagctgctatgattgatacgttggaatttaattcttcaacactttatcgttatgccaacgttaatgttaaagaacttcttcacaatctgggttctgcggaattaacgctgaaaggaattgagctttttatcaagaaatttgttttgtcaatgccaactggtaaacaaaatagctttgcaaataaaacaattcctccatacgtaatggtaacaattcgaaacgatacgcctgttaacttagtttcagcctttgaagaaccagttcgttcaaatgatggttacattagaaagtcaattgaaaaacttgaaaatgagtatgatgtaacccagagctttgttgaaaaaccagagacaacggttgttttgtccactaaagaatctaaaattgataatcaagttaaagacatctcatcactacttaccaacgttgcagaatgtttagaacggatgatgaacgatgaaaacattagtgattagaatagctgcgcctttacagtcgtatggagatccggcatcttttgaaaaaagaactacttttcgagctccaagtaaaagtgcagttatagggatgattggtgccgctctcggttttcgcagggaaagcgatgattacaaaagtttaaacgatttagattttgccgttcgtgttgatcaacctggcgaagtgttaagtgattttcaaattacccactatagtttaaagaaaccaggaaaactttctcatcgaatatatttgcaggatgcggtttttatggttgcacttagtagcaagcaagacgctttgatggaagaaattgagtatgcattacggcatccaaaatttcaactctattttggcaggcgatcaaacccgccagctggtattttaaaaatgaaaatgtgtccagataaaactgctataaacgtattaaaagagttgccatggcaagcatcagtatggtttcaaagaaagtacaagaaagatgtttttaatgcacgtatctatgctgatgcaaaattagttccagacagacctaatcgcttgattaaagatgctgttggctcatttaatcaaaaaagtcgatattatgagtatcggtcagttgccgaagataatgtttttttagaaaacagtaattactttcaacgaaaaaatactgatcatgatatatggacatcgatttagattggagagagattgcgatggtatatttatcaagagtagaaatcgataccaaaaatcgtcgaaaaattaaagatttaactaatctaggcgcataccataattggatagagcaaagttttccagacgaaattcaaaaaggtatcagaaaaaggcatttgtggcgtattgatacgttagccaatcgaaaatatctgcttgttgtgagtgaggataaaccagatttaacgatactatcacgatatggcattgctaatacgacggctactaaggaatactcaccttttatcaatagtatcaaaaaaggacaacagttacgttttcgtttggtagctaatcctgtattacgaaaaggtgctagaaagaatggtgagcgtgaaaggacttttccacatattacaattaaccagcaaaaagagtggttaattaaaagatccgagcgtgctggatttaagctctctgaaaatagttttgagattaaggaacgtgattttgtaccactttatcataagggaaatcgtccaataagacttagtagggttgcttttgaaggaatattggaagtcatagatcctattgcacttcaaaacacgctaatttatggtctggggcgtgaaaaggcttatggtatgggaatgctaaccgtcattcctatcaactagctgaggtaatggtatgaaaaaaataggagctgacaagccgaaactacaagagcttggcagaattggcgatcgaataagttttttatatttagaacacgcagttgtcaatcgccaagatagtgcgatcaaagttgaagacagtactggaatcatatatataccggttgcaattattggtgttttgttattaggaccgggtgttgatgtgactcatcgtgctatggaattaattggcgattcaggagctgccgttttatgggttggcgagcatggggttcgacaatatgctcatggacgggcactgggacattcatcaaagttactagaattacaggcaaagttagtttcaaacaccagaaccaggattgcagttgctcgtaagatgtatcagaaacggtttccaactgaagacgtttcacagctcactatgcaagaacttagaggtaaagagggttctagaatcagacgagtctaccgagaatggtccaagaaaacaggtgttgaatggactagaagagagtacaatcacgataattttgaatcaagcacaccgatcaacaaggctttgactgaagctcatcaagcattgtatggattgtgctatagcgtggtcgctgcattgggtgcttcacctgggcttggctttattcatacgggtcatgatctggcttttatctatgattttgctgatctatataaagctgagttttcaattccaactgcttttgaagtagttgccgcatatggggatgataacatagaagatagaaccagatgggcaatgagagataagattcgtgaaagtaaactgatcttaaaaatggttgccgatttaaaggatcttctcggtgatgatgatactcgcaatgcagatattattaatctttgggatgataaagaaggattgcaaaaatttggtgttcaatatcatgaatttggagatgataattcatgattgtgataactctttcgaaagttccgatgtcgttacgaggagatttgactaaatggtgtcaagaagtacagactggggtctatgtaggtaattttagtgctcgcatcagagatctactctgggaacgtattaccaagtcgattggaaacggtgaagcaacgcttatctatagtactaataacgaacttggctatacgttcaggactacacgaaaagacaaacaagttattaatttcgatgggttaccattcatcaagcatttaaaaaatagtccaggatcagtcgaacacggatttagtaaagctgctaagcttcacagagctaaaaaaatacaggaatcaaagcttccaaaggcaaattcaacttcgactagacaaagcatcacagaattggttgcaattgatttagagacaacgggcttaaagcctacaaacagtgagattatttcaatcagtgcagtaaaaagaaccaatgaacaacaagtagagaaatttaatcgatatattaaaatagaatcagaagttccagctactattcaaaaattaacggggctatccaacgattttttaaactcagagggtgaatccttagaaaaagtgttggaatactttcaagtctttattggtaataatgttctagttggttataatttgctttttgatcaaagttttcttaacgctgcatttataaaagcaaataagcaaattatttcaaatcgtatgattgatttaatgccaattataaagaaggatcaaaagtttttagataattatcggttagcaacagttcttaagaattatggaattgagaatgactatccgcataaatctatatctgatgcaatggctactttggacctagcgcttaaactaatcaaaaatgacaaactaaggatctaaaaaaggcgtcatatagggatctgtttacgtattccccatgtatgtgggggtgatcctgtaggagctgaataatcatgggagcacgtgaggtattccccatgtatgtgggggtgatcctcaagacatgttgttcaaacttgctgacgtgttgtattccccatgtatgtgggggtgatcctgagccgatgccaaccaggcaaccggctaacccgtattccccatgtatgtgggggtgatcctctaagtccgctaacgctttaaccaagcgatctgtattccccatgtatgtgggggtgatcctcaaggcgtggttgtctgcgtcccacagatccagtattccccatgtatgtgggggtgatcccaagtacgcgcatccgtgtcggttgccgttgcagtattccccatgtatgtgggggtgatcctttcttccttgaagagttcgagaacgcgatcgggtattccccatgtatgtgggggtgatcctcgatgatcataccgtagatgcctttaaatatggtattccccatgtatgtgggggtgatcctcgaccaggtcttagctgacaacgacttctttagtattccccatgtatgtgggggtgatcccaaggatatcggcgtatcaaacgaggttaacatgtattccccatgtatgtgggggtgatccttgctgttgccgtgccatcagccggtttgattggtattccccatgtatgtgggggtgatcctatcagatggaaggctgtcgtgggcaccaacaggtattccccatgtatgtgggggtgatccccaggatcggttcggttaacgagatcaccatcagtattccccatgtatgtgggggtgatccttaactggtaaacatcgttagaaacattctctggtattccccatgtatgtgggggtgatccttgaatggtcttcccggatagattccatggggtgtattccccatgtatgtgggggtgatcccgctatccgcttgatgatccgatggttgccgcggtattccccatgtatgtgggggtgatccctactaaaaataggatagattaagatgcggggcgtattccccatgtatgtgggggtgatcctagcgttggcggaaggcattgttaatttagtcttgtattccccatgtatgtgggggtgatccttgtcggttgttctgctgattgcgttgctgtgggtattccccatgtatgtgggggtgatccttaagccgtttagccattgcagcgttgctcatagtattccccatgtatgtgggggtgatcctcagtgcccacccggtggacgttagctctatccgtattccccatgtatgtgggggtgatcctaccggcgggcgaagttggtcaacctcgtcattgtattccccatgtatgtgggggtgatcctggtatcacttgaatatggcgcatcccatcgttgtattccccatgtatgtgggggtgatcctacatggcatacgcttgaaattgactacgataagtattccccatgtatgtgggggtgatcccatgatatccatggttagcagtagtaattatgagtattccccatgtaccactatggtaatccatcaacaagatttagtgtagagccaataaaaacggccattagggtataccctattggccagttgctttggctgtaataataaaatgcagctctgtttttaattaaagatattgttcattcaaatgtatgcttggcgaaacgatgatatgagagaaattgcagagcgatgtacgtgctactatcaaaataaatattgaaaactaatgctttactgcattatcgtttttccagtgtgctgtgaaatgagcttcagcgtgattatccgcaaaaatccgatgaaagattgataccaactcatctgcgctctcggtaaaggattgtgcagaaaactcgtcaatggctgaatgagaattaacattgaatagtttgagatactgctcattattccgataaaattcatcctgcttaattcccgtaaactcgatgtacgtctcaataattcgacgcattgagttaagcatggaatttgtatacccatgttttgccaaatcaccaagttctatccagagtgcatcataatttgtctgcatatcccgcttcgcatcagtaatctgaacgaatgacccttgccgcaaatgataaaagtcactcttatcatattttgtcttgcctttcttgtcttcaaatgccccatgcggaggaacgtttaagtaaaaatgaatattatgagtcatgattacaatgaagtctttttggtgatcaaagcgttctctttgctccccttgataaagtttctgcatttccgtaataatcaaatattgcatatcagagtcgttcgaattcattgggtcatcaaaaattattaactttggagacgtagatgtttgtatggttgtctcacctagtttctctaaaaaatataatagtgcaattacatttttttcaccagtggataactctttcactccgcgtagtgtgctttttttacctacagtttgtgaaacctggtaataaccagtctcttcattttctgtgtaagttaactgccacggaacaactccttgtaaacgtttgttgatgtttttaattgcctgtacctcggctttcggcttcaaagcatcaatttgatcattcaaattctgaatgtccgcttcaaggtctgcttgctgtcctacttttttgtcaaactcttctttgacatttttaaatgtttttcttacatcgttcatctgcacatatttcacatcatatttgaactgaccaagtaatttgtaaatcatgttatatcggagcttttcttgtgcctcccttttttttgttgcgagtgatgctccatactccttattattcttcaccaacgaattgtaactcgaaaaatcaaaatcttctggaacttctatgtctaattcgtctaactcgctaaataaatttttttctttggattctagtgcgtcttccaaagcgtcacaaaaggataatattatctttttatgtgcaactaaatcatcccaaatattccccgccgtttcctgatatttcggataaaatgctgcctgagtccatttcatgcttataattaagcttaataattgacttacttttttcttaccctcaacaattcggtttctcaatactgccacttcatcagcactaaagtatgattcgagttcttgaaaggtttcttcggaaatagcgtttccacaaaatgcgcaaatctctccgctctgatgtttatgaattcgcatgccttcttcagcaaaattaatcctttgctgattattttgaagccgtttaatacggtttttctcctcaactttactcttgagaatttcatttgtacttttcagatatgctgaatagttaacgtgcttccattcaacagtattaacgaatagttcctcggtttcaagcgtcttctttaactgagtaacatcaatctcttggagcgccgcagcgtgggaaatttccttcttaaagtcactcttattataggtcgtcttagatatttgcggctgagttctctttttgatgtatgcagctgagtccgaatagaacttgtcaatagcagtattatttttttggactgctgcttccgccgccgccttttttgctttcagattatgtatgtccgagtcatcaatctcactagtgacccgctttaactcattttgctttgcttgaatctccgtttctttctgcttaattgcaagttcgttctcaccagcatttatcgaaagcgaaaatgcattcaacttctcattttcacccaatacagtatcaaaaccggcaaatactcgaacatcgaaatttggagaacattgttccttcaaaagtgaagcaaaagtggactttccagagccatttcgtgcaaaaataaaatttttgtgttttagtgaaacatgatcgtctttgaaaatctgaattccatccgtaaatttttgcttagtcaaatcaatatttagttcattcaaaataatctctcccagaaaatgtctcaaactttcagctcatatttagcgcaaattcacttttgctcaaattgagtatacttaatggctgttcttccactttctaatttcaacttttagaaagcttattttattttgttgattaaacttatatctatcaaaaccgtgaaatacgaacaatttgccatcttttttgcaactggcaacaccccattcagtttcgtaatcatcactattaggactgatacaatataaatggcgtagttcctgattatccctaaaaaagttctcaaaaaaactagtaatcttagttggattattagcaacaaccccattagctccctcaactacagcatcatcgaaaaataatcttaatgggaagtaacaagaaggtgacaagtactatttttactaacgctgacatcggcacactaacccttactcaaatattgaaatcactaagtgaccccacttgcttagaaattgtatccacactatttaaagaaaatcaagaatgttcctgtgaaatatttagtgacctaggtagtggctggtgaaagctgcatatttttcgagtattgatccaagaaaccgtgtaaacccttgaaccagagacagacataaatatagaatgctgatgaattagtatttgtttctcctctaaaaaatatgaaattttagatgagatgatctcaaattctatcttgtttgtgctcaaacctacaaagtgcgagaaaagttgttaaattgacgaatagccttacaccaaaacttgtaagtgatcatgttcaaatactgatgtgtcaagatatgaataagctttcaccagccactaggtaagaaaagcaaattgtcacaacatacactagcggacgttgaggagggatattatcgtttcatttgttcatctatgttcaatttgaatttcatgcttaagtttatctacgtaccttcctaggtttttatcaaataacgattttatattgcaaaagtcagttatagatttgagagcattcccaacaaagagcgtactaataaatattggtatattgtcgtctggattgtttttaggagccatatttgatacatcatattcttggtaaacattagttgcatgtactcttttcgaagtctgatgcataaggagattgtaacgttccccctcattaacatatatagctaagttttgtaaaccatgcaagtaatttccattcgtatctttgctaacattataaaaatctttaaagtccttagggctaatactgatggaattgttatcaaagaattctttaatcttatcgttgatattgtctttttgtctttctaattccccttcttgtgtgtcggatttttttgctagttctattgctttgttcctttgtatcacgtctttaggattatttgtattaatcaattgagaattaaacaaagcatttataagctttttaacctcgtctctccgtgcaattaaattgtaagcctcttttttaatttcatatgttgccttattaccctcacttttagtcaaataaagaacataaaagtaagtttccataattgtacgactaattatttgaggaatagatcggttttttggataattatttacttcaaaacaatataaatcaaccatatatttaacaagtaaaaccaataagtcgtattcttctagttttccctgacttttaagctcttctgctattttatttatattagattctgcccttttggaaataatttttgtggtatctatcaaagaagcacccctttatctgctaatatcaattagtaactattgtttttcttttagtcaatcttaccactattttataagttatatttgaatcacgataccaataaaatctcgctggttcttttattttaaacgtggttaagatgctagtctgcctgtataatagtatcttgtagagaagttaaggcggtggctatttccaatcggaggtggtgcttatggtgttaaacctttaaagcccataaatcctaacgaaaggagtagcctaggtgtccgtgtcggacgctttacaattaatgctggctttcggtacttttatcgtggccttaatcgcattaattgttgagctgatcaaaattcagcaaaaaaaataaccgccttagctctggtcagctagcggttattaaatatcgttaaaatctgccaccgtctttaacggctctacatgggaagccctgttctagcgggacttcccttttctggttacattataacatggctataactgactttcgactatttttaatcagctttctagcagtttttagggaacatacgtttgctttttgtgctacaatacaggtaaaacttaacggaagtgatgaaattgtttactgatgatgaaccgcatggcgtgttcttcttaatcgataacaagtccttttatgctagttgcgaagccgtttcccgggggctaaatcccttaaaagtcccattagtggtccttagtgaagctgaaaataccaatggcggactcattttagccacgtcacccgaagctaagcacttatttcatcttaaagccaacgtctcccgtaaacgtgacttacccaacgaccccaggttgtgggtcgtgccaccgcgcatgaacctttatattcaacgtaatttgcagatcaatcagatctttcatcaatttactactgaaaaagaggtttggccgtattcaattgatgaaagcattcttgatatgacccatacttggcggctgtttggcaattccgttcgcgaagtggcacgcttgattcaaaagacagttcggcaaaagctaggcttgtataccaccgtgggaattggtgacaatccggtgcaagctaaattagccttagacctttacgctaaacataatcatgaattgatcggtgaaatccattacgaaactgtgccggataaaatttggtcaattactgaattaacggacgtttgggggattggcccccgtatggcgaaacgtttgaaccgtcttcacattcacaatatgtatgagctagcccataccaacccttatttactcaaacagcagcttggcgtcattggtagccagttatttgctacggcctggggaattgatcgcgcgcaagttacggaaccaactaaggttaaagaagctagcctgggtaattcgcaagtattgccacgagattattttaaccaagtcgaaattgaaaccgtcattaaagaaattggggaacaggtggcggcgcggcttcggcaccaccataaactggcggggtgtctatcgctaagcattgggttttcctatgctgcagctgaagcagatggtcgcggtggttttaaccaggctttaaaaatggaaccaactaatgataatcaagttttgacacaacaattattgtggttattccgtcagaattgggacggtcaagctgtccggaatattggtgtttatagcagtaaactaagtgccaattccggccaacaacttaatttatttgaaaccccgcacaaccaaattcgccgtagccggttaaaccaagtgattgatgaaattcaccggcaatttgggttcaccaaactagtttacgcgaccagtttattaaagggaggcaccgctatcaagcgggcttcactagtgggcggacataatggaggcaatagctatgaatagcgatatcgagattattaaggggcggttaaccttattgtttaagcggcgtccccaaacccgctattggttaatgttgactaatgacacctacgatcagacctataatctgttttttaacagtcaacgggctaatgagcgttgtgttttcgtttttataagtgtcaacttgacaggggatagtaccataagctgatatcaacctcagttgataaagagcccaaatcactgtgcaatatatctattagtgccgaaaggcttttgttaaaagacacttcaaatagtgattgggattttttcctttgaattcggtggcctacttgttttgcttagaaaaattggcgcaaaatatcttttagtggtggtagttcaggtatttttttctcttctttaaggtattggctaccaaatttcatgtatcctttagcttcctgaccgacaatcttgcccggcaaaggtgcatcatcactgacataagcattgatcagtaccggcatattctggacccgataggctctgttcaatgcgttcttaaattcttcggaagttttagcagtaatgccaacaccgccagccgcatcggcaaatttggcgtaatccatatcctgtaagtcgatttgataatttaattggccggcggcctgttgttcgtattcaataaaggccagctttgaattattgagtacgatattaattaatggtaacttgtatttaactgccgtaatgaagtcctgcatgaccattgcaaacgcaccatcaccattaaccgagataaccggtcgatcgggataatttatttttgctgcaatcgctcctggtaatgcacatcccattgtccctaagtaagaggacaagataaatttttgtgttggtgatacgtttaagaaacgggcgctccaagaggtggctgttccaacatcaattgaataaattgtattaagcggtgccgtttcattaatatcgttaaataatgcttcgggtgcaactggcttggaatcgagttcacgtttgccggtcatccaacgattccagttagcaacattttcctgacaggcctttaagaaaccatcatcaggatggaggatcgttgtttcagaagaattaagttgctttataacgtctttgatatcggctaccaatccaacatcagccggataacgttttccgattgctgacgcactggtattgatttggatgcttttggccgtccctggtttgggcaagtacgcggtatagggataatttgtgccgaacattagaagcagatcggtattttgcatggcttcataagccggctttgtccccaacttaccaacatttcccagcgaattaggatgattgtcgccaatgatcccctttgcgggcaacgttgaaataaacggaatatggttttgctctaagaaggccgcaacctggctgccggctttttttgcccccaagccaaccaatgcaagcggttttttggaatcacgaatcagtttagcggctgtattaaggcgattgtcatctatttgtggtgatgtcaattggaaagaagaagcggaactggtatagtggtcgctgaccctttgttccggaaggttatccggaatggttaaaactgcgactccatgtttctcataagccgttcgaatggcttcatcaacgatttcagctaaattgtcagtggcagaaattagtttattatagaccgcaacgtccgcaaatagttgtggtgtattcacttcttggaagtattcctcgtttaaaaactgggtatcaacctgaccaagtaaagccagtactggcacgtgatccattttggcatcataaaggccatttaacatatgaattgcgcctggcccaccgattgaaagacagacaccaagcttaccggttaacttagcctcggccgctgctgccaaggaagcaacttcttcgtgacggacttggacaaatccgatctgatcctgttgtttgcgtaaagcatcgacagttgtatcgatggaatcccccggtagtccataaacgtgttttacatgccaatcaattaagacgtcgactaattgttcagaagctttttgagccatattgcgtcatcctttccataaacgatgttaagaaagcttactttcattgtggcgaatttacaattgaaatgcaacacaaagtggcgaatttacaattgaaatgcaacacaaagtaaaaaaataaacccataccgggtagaataagagccaaaatataccacaaacttgtcattttccttacagaccctgaaggatgcttacaaggtaagtccaaatgaacaatattatttgttggccaatcacccattacttcatccacgggaactcatgattgacgcccaccttgctgggcttcatcttaaccattatcagccgctgcgtaatattaaggaacggatctggacaattgacgattccagtactgaacggaagctgttagtggatcatgtggccggaatcattaccgataactttgaactggccaacaacgtgaagaagagcgtgctggtttaatcatttaaatggcttatttctaaatggcttatttcaaattgcggggtcggggcagctaatcgttgcgccgacctttttgtggatcacggtttactttcaaatgtccggctgacaaaatttgtaaacggttattttgaatccactctcctcctccgctataatgaagatggtagtagattgtgtacaatgtaatggactgtcgattgtgaattggaggtatcctatatggcaaatcaatatgattatgatgttttatatttgggtagcggtcacggaacatttgatggcgcgattccgctcgttcaatcgggcgcgaaggtcggcgttgttgaagcggatatgattggcggtacttgtccaaactatggctgtaacgctaaaattacgctagatgctccggttgcattaagccgagaagttgaacgactcgccggggtggtcgatggcaagctgaccattaattgggcaaagaatgtggcccacaaaaacgacgtgattaagggcttgccagggatgattggtggccttcttgacagtgttggcatcgacgttttccacggtaagggaagcttccaagatgcccataccattgttgttgacggccaagaaaaaactgccgacaagatcgtggtttcaaccggactacggccacaccgtctcgatattccgggaaccgaattggctcacgacagtcgtgagttcatggacctcactgaattaccaaagaacattgcgatcattggttcaggatacatcagtatggaatttgcgacgattgccaacgctgccggggctaacgtcacggttttgatgcacagtgataaggctttacgcagtttctatcaaccgtacgttgagcaggttatcgcggatctggaagaccgtggagttaagttcattaagaacgctaacgtttcggcattcgttcgcaatggcgatcaatttgacgttgagtatggcgatgacgataagttaaccgttgattggattttggacgccaccggccggattcccaacgttgaagatattggattggaaaaggttggcgttaagtataatgcccatggtgtgattgtgaatgatcatttgcaaaccagcgttgagaacatctacgcttcaggggatgttatcgataagactcagcctaagttaaccccaacggccgtgtttgaatcaacctatctctgcaagctcttctcaggtcagatcagcgatgctattcagtatccggttattccatcggtagtcttcacgtcaccaagaatcgccaaggctggcgtatcggttgaggacgctgagaagcaggggctgaccgttcaaaccaaccacttgccggatgattggtatcggcaggttgataacgaaacccaaggtgatgacaccctgatttttgataaggatcatcacttggttggcgtcaccgaagtcagtgagcaggcggacaacgtgatcaatacgttgctgccggcgatggagtttaagtttggcgcggctgaactcggtcgactggtttacctcttcccatcgatcagttcggctacttggggccagctgtaaaaaataatatgccataaacaaaatctgttaggagtcatggatgatgatcctaacagatttttatttcccggatttacaatctaagtgcaacatcataattaaacaaaaaggccatgaagacctaaacttaaattgaccaaaaaaataagttttcagaaccaacttttttctaaaattccaacaaaactactgcatccattataatcaaaaagccgtctaaaaggcgacctaatgctaaaaaatggttattcaggagacactaagaatgtggtttacatttaataagttgtgttaaccaaattggttgacgctatttgtaatagcttgaatcaggacaatttatgatggcgcaatcaaaacagagatgcttaaagcttgaaatagttggcctgttaagaatacaataataacaaatataacgataaattcatttatcgcgtagttcaagttgattgattctctgttttaaaatgaggaggtctttctcgtgtattatagtaaaggaaattatgaggcgtttgcaacgccccgaaaacctaaagacgtcgagaagaagtcagcttatattgtcggctcggggctggctggtttagctgctgcagcttttctaattcgtgatgggcagatggccggtgaaaaaatccatatctatgaagaattaccggtagctggcggttctttggatggcacagatcggcccaatgttggctttgtaacccgtggtggacgagaaatggaagatcatttcgaatgtttgtgggatttgtatcggtccatcccgtctcttgaaattaaaggtgcttcgtacttggacgaatattattggctggataaagatgatccgaattcttctaattgccgtttaatctataatcgtggtaatgaggttccagacgatggtcagtacacgcttggtaagacctcaaaagaactaatcaagttggtattgacgccggaagaaaaattgggtaccgaaaccattcaagaatttttctctgatgcgttttttgagagtaacttttgggtgtactggtcaaccatgtttgcctttgaaaagtggcattcagctgttgaaatgagacgttatgtgatgagattcattcatcacattgatggcttgccggatttcacggcactgaaattcaataaatacaatcagtacgaatcgatggttaaaccgttaatggcttatttaaccgatcaccatgtcgatgtccaatttgagacaacggttgataatgttttggttgatttagaaggaaaccagaaagttgccaggaaattgttactcaccgttagtggtcaaaaacaaaccgtaacgttaacgccaaatgatttggtatttgtcaccaatggatcaattacggaaagttcaacctatggtagtcatgataaaccggcgccgattactgatcaaccgggtggttcatggatgctgtgggaaaatttggcagctcaatctgatgattttggtcatcctaaagtcttctatcagaacttgccgaagaagagttggtttgtgtccgcaacggcaacgattgaaaacgacgagttggacccttacattgaacgattaaccaaacgggatctgcatgcccacaaaatcaattcgggcgggattattacagtcactgattctaattggatgatgagttttgcggttcatcggcaacctcattttaaagaacaaaagccaaatcaaaccaccgtttggatctatggattgtattcagatgtcgatgggaattacattcgaaaaccaattgaaaattgttcaggaaaagaaattgctgaagagtttctttatcatctaggcgttccggagagcaagatcgatcaactttcaagtcaggagtatatcaatgtagtaccagtctatatgccgtttattaccagttattttatgcccagagctaagggtgatcgaccaaaagtggtgccggttggatcggttaatttagcctttattgggaattttgctgaatcaccatctcgagatacggtttttacaacggaatattcggttagaacagctatggaatctgtctatacgctcttaaatattgaacgaggggttccagaggtatttggctcagtttatgatattcgtgagttgctgaaatcggtatattatatgaacgacaagaaaaaactcgaagaaattgacctaccattaccaaagccgattcgaaaattaggcttgaagaaggttgaaaaaacttggattaaggagcttttggaagaggcccatttaatttagaaaaaaataagcgtgccagctttgacaaaagaataagccatccaattctcccccaagaaaataagttagtctaatgaattaattgtacaccttggggcggttgacggcataacgcccttaattacggtggtaaataaccaccgcttcaaaaaaagcaccggccgcggccagtgcttttttgttgtttttaattcgttgccgacccggcaatccgggcccagttagattggacggtggcgtttttggttggcgtccagaccatgccaccgttagttgattgggaaaccagggcgaccggctggccgttgtggtaggcaaaggcgtaggtgatgtggtattcgccaatgttggttgaagcgttgccgtcgccttgcgggctcttgttgtagttgtacatggcgacgacgttgtaatcgtagttgccggtcccggtggtggaccattcaaaggtcgagccgtccccttcgtaagagccgatcgtgttgttgacgccgccgaaccactggtagtcgcccgggctgagttcggcgtaggattggtgcatcgatggcccccaggagttcataaaggaccgcagttgctgggccttagcggagttccaaggggtgctggaagtggcagctgcctggctagaactagcggagctggtctctgcttggctactttggctgctggtcgacgaagacgtctgggcgctgctgctttttttagcggtggttgacgagctcgacgccgttttggatgagctggacgaactagaacacccggccaataagaacagggcagcccccagggtcagggtgccggtaataattttatgcatgaaactctcctcccaatggataatcacttgttatttctagtgtaccccgttgatttgacatatgacaagacgaaatcggtttcatcatgtatcctaagggtatcaaaaagaagggatttgagattatgccattaatgaagtttgacatgctaaaggggcggacgcctgaacagatcggcgcccttttggacatcgtgtacgaggtgcaattagagaccttaggcacccctgtaggtgaccggtaccaaatcgttaaccaacacgaaccctacgagatgcacatcttagacaccgggctgggggttgagcgcagcgaccaggtactggtgattaccgtcatcacccggccgcggacgaccgcccaaaagcaagccttttaccgccgagtggtcgaccggctccacgacgaactaggaatgcgcaaggaagacatgatggtctcaatggtccaaaacaccgatgaagactggagtttctttggcggtgacgcccagtttttgaccggggcgctatagggcgccgtggtgaatcgtgatttggcggccccgcacgctgggcttgccctcggtaaccagttgcttgaggcaccggcttaaggtggccggcgtgatgcccagctagttagcgacctcgcccttggtcatcgctagctggtaggtgctggattggtaatcgcgttcccagtccaggaggtaggcgtagaggcgctccttggcgtctaacaaatggaggcgggagttgtcgacctctagttcggccagccgggcgccgaagctgttgagcagctcgcgggccaacagcggggaagacgccagtaggtcctgaaaggcgtcgtggcggagccggatgaccgtagtcgggtaaacggcctcgatcaggcgggctaagcggggttggcgaacgaagagggcggcctggccgtcgacgtcgccgccctttaagaggtataagatgttttcgttgccgtccgcggtcaaaagcgacaccttggccttgcccgccaccactagcaagagggcctgctcgccctggccgtcgctaattagctccccggcctggtaggtggtgggggggctggcgatttgcgcgattttagtcagggcgctgacgggtaaattacgaaaggcccgcaccgcccgcagacggtcaattaaagtttccacgatgagttctccttttgacataaagcaaattgggcttagaataacctgataacgtaaagaagtaaagcatttcggaggtggattatgcaagttgaagacgcccttaaatcccgccatgcggtacgggattttaccgaccaacccgttgcaaaagaaacgatccaagaaatcgtgcgcttagctcagcaaacgccgtcctgggtcaactccgagccctggcgggtgtacgcggcgaccggccagtcgctgacccaaattcgccaggggtgtttagacctggccgcccaaaaggtggcaaccaacccggaccttaaaacgatgagccgggacgactgggacgcccggccgcaaaaactgatgaaggactggggtcacgacctggtgcattcctttaccgactttgacgaggcccacacggtgatgaccggggccagcgacgccttgaataacgccccggcgattctcttcgtcacgatccctaagcaaacgccggactgggcgatcctagacgccggggccttcatgcaaagcctcttgctggcggcgacggccaaggggttggggtcgattccaacctacaacagcgtccgctacccgcaggtggtccgccaagtactggggatcccggaaacagagcggctcctggtcggggtcgagctcggctacgaaagctcggccaaggtcaatgcctttcgggcccagcgcccggacctcagtgatgttttaaaaatttcagaataggggcgattactatcatccaatacaaaaccgttaacgtcgacggcctcgacgtcttttaccgtgaagcgggcgacccaagtaagccggcctttgtcctcttgcacggcttcccgtcgtcatcgagtatgtttcgcaatctaatgccgctgttggcccgtgatttccacgtgctggcgccggatttgatcggttttggtaactcggcagcgcccagtcgcgaatcgtttgagtatacctttgagaacctgaccaagaacgtggccggcttcttagccgcgctcaaggtcgaccaatactttttgtatgtctttgattacggagccccgatcgggtttcgcctagcgatgcgccagccagagcgggtgctgggcatcgtcagccaaaacggcaacatttaccaagaagggctggggccgaagtgggcagaacgggctaagtactgggccaatccaaccccggaaccgcgggcgcaatacgaaagcgcctttgccccggagacgattaagggccagtatttgaccggcgaaaagcccggtacggtcggcccggatggctattccttagacatcgcccacaccacggagccgggttacgccgagcgccaagacgacctgatcttcgattaccagaccaacgtcgccttgtacccgcagtttcaagactatgtccgccagtaccagccggaaaacctggcggcttggggcaaaaacgacccctcttttatctacccgggggcaccaaggtcttaattgcgaccggcctggccgccatggcacgtttaaaggccgcccatcagcagctgaaggaggtcgccacggcgttgagcacgaccccggaagaggtggtcgccgccgctagcgacctgctggccaaaaacaaggccctcaaaaagcaacttaaggccgctaccaaagcgctaatggcccagcaggcggcgcaggtgctggccagtggccaacaagtcaacaaggtccatattgaaagcgccggcgacatttcggtgttggcgccgttagtcctaaagggggctggcgaagaaacgctcctgtgggccaagctccaggcggtggtggatgaaatcaaggccgccgggggccaagctagctaccggactgttgacgtcaccgacttgcaaagcgtcaaggacttggtggcggccgcccaagcagaatttggtggcctcgacgtcatctacaataacgccgggatcatgccgaactcgccgatgagcgaggtctgggttgacgagtggaacgccatgattgagatcgatttaaagggggtcttaaacgggattgcggcggtcttgccggtctttaaggcccaaaagcacggccacatcatcgccacctcctccgtggccggggtgaagaattacgtcggttccggggtctacggggccgccaagtggggcgtgcgcaacgccatggaggtcacccggatggagagcgccaacgaaggcaccaacatccgctgcacgaccctgtgcccggccgccattgataccgagctgcttgatcacatcggctttgaaacgacggccgcaaatatgaaggccttttacaagcagcacgccctgagcccggaagcgatcgcccgggtggttaacatcgccgtcgatcagcccgccgaagtcgacatcagcgaagtgataatttacccgaccaaccaggcttaattaaccggccggcgcccccatgatgttgcttgacctcaagttaggttcaggtgctatcataaggccaacaaagggggcgtttaaaatggaaaacgtaaggttaaataacgggataacggcgccgatcttgggctttgggacctaccagattagccctagccaaaccaaggccgccgtggctgaggcccttaagctgggctaccgcagcatcgacaccgcccagtactaccgcaacgaagccggggtcggggcggcggttaaagaaagcggccttccccgcgaagagttattcatcaccactaaggcgatgacgaccggctaccgggccaccaagctgggatcgacaattccctcactgaggccgggctggactactttgacttgatgctgatccactggccgatgcaagacgacctggggacttaccgggcgctggaggaagcctaccaggccggtaagctccgttcgatcggcgttagcaactttaaccgcgcgcaactaggtgaaatcatggccaacttccaaacggtaccggtggttgaccagatcgaaacctgtgtcttgcgccagcaaaccaagctccaccagtacttagccgattaccagattgtccacgaagcctggtccccactgggtgagggcgccggacggttatttaaccacccggtactaaaggacctggccgctaagtacgaccacaccaccgcccaggtgatgctacgttatttgacccagcgccagatcatggtgatcccgcgctcaaccaatccgacccacatggccgctaacctcaacatcttttactttgccctaaccgcagccgacctcgcccgggtgcaagccctcgacgagaagttctcgctttccggctggccgtccagcatgaccttggacgaagattactaatgtgttataattggataaatgatgtaagaagtagcggatcacaactgaggaggaattttatcatgtcagataatggaacagtagataaaatcaagggcacagtaaaagagaccgcaggcgatgttactgacgacaagaagctgaaggccaaggggatcttagataaaaccgtcggcaaggtaaaagaagccgcagaagacgtgaaggacactgcggaaggtgtcgctaaggacatcaaggaaaaatttgataagtaatcttaaaaatcaggggtaaccaaggacgctgaatgtggtacactgaaggcattatcaagatgcaaaagtgtgtcatagggggttacctccagatacagcaaaagtccggtgcgttggtgctttctagccagcaagccggcttgggcgcccccatcggcgccttttttatttccgaatttacttgacctcaagttaacttcaggtgctaggatgatgataacggatggttgaagtagaccttggaggccaaaacaacttggtcgcgggcgacgtctttaagcgcccggcccaggtattcttcgctggtcccgtaggagtagacgttggcggtgtcaaagaagttaattccggcgtcgaaggcgtggtggatgatgcgatcgctcgcttgttcatccaaggcctaggagtgggtggagccgtcgccaaagctcatgcagcccaggcagagtttagagacttgaatgtcggtgttgccaattgttgcgtattccatggttatttcccctatcaaaattttcatttcaacttgttaccaatttcaataatccataaaacataatttcaaccttttttctttaaggattttaatgttctataaatgccaactgttctgagcaatcctaaatgttgcaatccccacaaaataaatttatgttgaattgtgtctgcatatttaaatgatcggtcgtccaagggaattgtttctattaagtttttatacactttagtattaggatttaaagcaagatagcctccaacaatacgagaaataaaataggccgcttcatatttagtaaacactaaattatcattaaatataaacatgctatttttataaacatacttagcatcgttaacaatgctattagtagcattgtgtgtcaccgaattattattatcttgataatatataaaaatgtcgccttgctttacaagaattgtttctactttatttaaaatcttcatattaaagaatagatcttcccaacatgacagattaggatcaaatttaatattatactttagaataaaacttcttaaataaagcttattggaggctgacatttcatattcatcagggataaattctttatattttccatataccatggttagtgccaaatactttatatctttgcctttaaataccttattattatgattttgaggtacccgtgcactaaatgaaacaacctgagcattaaatctttcattattgctattgctaaataatgattgaaactcactactcaatgcatcatcagaatcaaaaaacactaaatattttccattagcattttctattcctatatttctggcagtactgacacctgagtgggataatttaataattttagaaataatattcttgttgaaagtgaagttacgttcaatataacatgtatcatcagtagagccgtcatcgactaatattagttctaccttcaaattattacaatataagtttatacttttcagtagccttacgattgtattttcactattatatgtcggaactatgatacttacatcaaaactctgttgttcatccattttcatactccaaattttactttacttgtttctcaccctaattaagtagactactgacttaggcaaagaacctactattaaaggcttaatggaaaacataaccacttttacaaacggtaaatctaaccgtttaaaatttacaaatctaatatgtgcttcataaattcgataaatatattttgatttctttttagcttcgctttctccaatatagtacttataaagagagcgttgaatattgtagcctttcatacctgctatatacattcgcatgaataaatcgtaatcttcagcacgccttgtttcattagcaacacgatagccgttaacttttatcaaatcttcttttctaaacattgtagccggatgtaaaaaaggcgagctccatagaaagtcgtttttagtgggcacccttttcattttttttatgtgttcaccgttactactttctaaaataaaattagtcgaaacaaagctatattctttatgacttgttaaaaagtttaattcaagttccaatctatctggtaatgaaatatcatcatcatccattctagcaataaattcaccattagcattctttatgcactgattcaacgcaaatgctagtccatgattttcttcggttgaaaaaagttttatccttttatctttttttgctatttcttttagaaagataagcgtatcatttgttgatccgtcatcacatatgataaattcccaattcttatatgtttgtttctctatagattgaacagctcttatacatttatctttagagctattgtgaactcccattattacagaaataagatagtcttttctcataaataacactccaatttacaatgtactataaggtacaattccccccatattatgagatagtttataatatagaagggaaaatccagctaacattattattattataagaaccagttttattaacatacgataagtgaatttctcacttattacattaatagttttaggcaaaaatagaggaacaaaaatagaataataatctaccattctcattaccaatgtattttttgcaccaagaatatacaaaatagttgcaattaacgataagtataaaagtatacttatcgttgcattttgatatagagactctttattaattattaaggtagcgctaatgaatacaaaaataaagatccccagaagtatagatcccccacttgctgtatactcattactattatcatatattttataatgatcaaatatattagagaatatactaaaaaggtaatttgacatatatatcaacaggatagacgcagaaattgttgtaactaatgcgtgttttgattttcttatccgaacaacaagaaaatctagtattgcaattatagaagtattatgtattcccagcgccagtaaaaaaaataaacctgcttttcctttttgctttttcaaaagagcaaagggaattaacattacaaccattactgctaacatttgccgttggacattaaaagaagcaaagtaaaagtacaatgttatgtataggtatatactcaaaaacctttctaggaaagtatgttggcaagaataaacacaataaagaaatattgaaacggtaaccgtagaaagtaaaaaaagaaatacatgatagtcgtttggcgcaaaaaaccaactaattttcctcaacaagtcatacacaaaggtgtcactctcaacaggttcattagctaaataaccattaatatttgttagggtatcagttcccactctaaacgaacgtaaccccattattgacactaattgaataccaactagccaaaaataagttttacttaaattaggcttaataatatagaaaaaaaagctatatattataaacacaaatagctgtatccagtaaaaattcaattttaactctccactcgttagtttgctgccatatacgtatagtgatcttgcaaaagttagattttaatacttccactcatgaaccgatagtatatagctctgtccgcatctttctcaaacaatcctttataagaaatttaaaacaagctatcgtatatttaatatatattactttggtaagaccattatcatttgtatacttgtaatttcttgcattaaagtattttactaagtcagggctaaacgtgagtataaaaggcccgtcacctaaagttttaggaaaattattaaaaggttctatatagccatttaaatatactggtgttatcttttccatttttaacaatgctttaatatttaaatgaggtatacttgttttatttataataattagttttaaacttggattagagaaaaccacattaaacggaatagagccattcaaacaaactatctctttacttttctgaaaaattgctatttgctcgacaagagacttttcttcaggatggatagtactatattcgttgagcctaaaattgttttctatattaatttctccaaattcatttttacgtgcttttcttaagtgagtacgtgataaatatatttttttaggtactactatatctttaatttttgcatttgaaatcatagttttaaatattttaggatattcattattgtactcatgctttgcattcatcgccatttgaggaataattatttttctatatttaacaggcttatctacttctacaatattattttcttctatacccaataatttaagtgcttcaagataatttccacttattggtttatctttttttataaatgcaacttttattttttctctttgataactagaaaatgtattaataaaccatgctctactaagtgaatctaaaataaaatgtccccattgctttatgaaaacacctaaataaataattgtatcatccacaaattctacatgtttcggtatattgtatgtaccaccaaatttaaagaattcaccattatgataagacaagtttataaagtctttattagaatcaattactccccctttccctttttttaaaggtaaaatataaccattcttgatagtttccacttttagcttttgctcaaaaaattttcccatttattatcacattttctaaatactttagaataaatcattgaaaccaatatattaggctcagttaaaaaacatatccaatattagttctaatctactgttgctctcgttctaatattctacaataaataccatttactttttttaattgattttcaagtttaaatttttggttaaataactttaagctttctaatcccatcttagaaataatttcaggattattaataaaggttgttatcgccttttttagctcatcatgattatttactaagaatccatttacaccattttttactagctcattatttccacctacatctgatgcaattattggcaagccaaaactcatagcttcaataatactatatggtaacccctcataatgacttgtaagtataaatacatcactgtcgattaaaaggggggcaacatttttttgaaagcctctaaaaataatgttactattcaaattcagcttttctactaaatttttacaatcatttaataatatacctgaccctacaaaattcaatatataattttgagtaggtatctccttaaaagttctaatcaacccttgctgatctttttgctttgaaaatctagcaaccattgtaaactttagtggtaatttatgtgctgattgtaaatcagaactattactacatacactatttacggcattatgaacagttataaaatttccctttttttgattcaaaattttgtattttaagccaagatttttatcaaattcagaaacacaaatatattcatcagtaaatggagctaataatttttcaataactcgaaaaattattttattcgttctagattcaaccccttcggtaaaaggccatccatgtattgtataaataagctttgatttacaattaatatttgccaatcgaccaatggcacccgccttagaagaatgaaggtgcactaaatcgggcaattcacgttttataatgtttttgaatttaatcaatgctattgtatccctaacgggattaatctctcttaccagatttaatatatatatttttacatttgggaaatctcttttaacccgcgatgttaacggcccacgattaccaacaaccaaaataataccattttctagtttagattgatattttattaattggtaaacgttttcttgagctcctccccaagtcgaactcgtaataccatatagtattttcataattctacctagctccgtctcctgtaaaaataatttgaatagtctcaaaagcaattttgaaattagaaattaatgaataatgttcaatataataattatctaacttacttttttcattcggtttaaggtcatatctaccatgaatttgtgcataaccggttaatccaggaattatactaagtcgttgtggaaagttggaccactttttagaaaatttttcaattttgatttaggaaccggttcaccaatataatctaaaaatgaatatttcttagttgagttagtagtaactttttctactgaagctgccaaaagaatcctcctattatttttctgaataatacttccaatagttggttaatccatcatgtagtgaccattgaggcttaaaaccaatcccttttaatttagaaacatcagctcgtgacttactaatatctccctgacgagcttcttttggcagattgtaaaatttaagttgaacatttaagtggacagaaaatcccatcaaggtctttaatggtgttaccacacaatccattagaaagaaggaccttgatgagcaccactattttatcattccagaaccgtgttatcattgaaacgcttcataatgaaggacgttccttgcgatacatcgctaactacttagacgcggggtgctttttttgattggtggctaagtatgggcaaagaacgccgcctggggcgccaaccatttgccctagcttagcccacggcctgccaatggctggtccgcacttccataacgtgcttccaaccacgtgcctagtgcctaagcaggctgaagaacgatgcgtaccgcatcaaccttcacccaagcttagtcatacggcccgtcgagaaggttggtcgcacttccaccttagtacttcaccacgtactgcagttggtagtgttgaggcttacccgggcgcaggaccgtgtcgccaaaggccgggttgttaatggcgtcggggagggtttgaccttccagggccatggccatccacggttgagcggggtggtcgaggtccttgacgtcattgtccaagccgttggccgtgtacatgatcatggcgttacggtcggagtagatcttaacttcacgcccggtagccgggtcgttcatgatggcgaccggcatgtggtccagggtattgcttggttccaccacgaagtagtcgtcaaagccgccctcaacggtttgggccttcatttgggccaaggcgtcgcccatccgggtagcagtggcgaagtcgtacggggtgccctcgttaaccagcttttcgccggtcgggatcttaccttcgtccacggccaggtggtgtttggagtttaaggtcagcttgatgttttcgatcgtgtcgtcgtcgctgatgttccagtaggtgtggttggtcgggttaaacagggttggttggtcgctagaagcgaagaagtcgatcgtcaaactgttgtccttgtggagggtgtagacgatcctggcgttttcggtccccgggaaggtgtccatttcctcggtgaaggtcttggtgaagatcacttgaagttggtcgtcgacttggtcggtcacggcgtcccaaatttggtccttaaacccgtgggaacccccgtggatgttgttgttcccctcattttgttcaacttggtactctttgccatcgataaagaagtggccgccgccgattcggttagccacccggccaatcgacttgtttaagcacagaccgttgtccatgaagccggccaccgtgtcggaggacagcaccaggttcttgtggccgccgtccttcgttggaacggcgtaggcctgcagcaaagcggccaggttcaagacgctaacttgaacgccgttatcgttttccatcgtgtacttaatgacgtcttggccctgccaagtaccaaaggttgaagtcgtaatttgcatatcaaaaacatctccttgatgaattagtaagcgttttccacgttccctattgtagcatagctaagggcgcgtgcggctgtttttcgtaaaactttactaaaactaactttgaaacaatttgtgacatttgtcttataataaaacaaaaatcctaaaatcaacctgttagagatcggtgtcccactctataatgtggggcgttagtttggaatggaggaccgggaaatgaaagccaaccgaaccgtgcgggactttgaagtcgccttgatgaacctactgctgaccacctcatttgaaaggatcaccgtcgatcagatttgcgacgaggccctcctgcaccggagcagcttttaccgctactttcatgataagtacgacctactcgagcaagccttaggggcctgggtggagcggattgttgaccaaaccgccaccgaagacgacctgatcgaagccttagtcagccaaatcgaagccaaccgggctatgttttccaacctggccaacggggggatgcggagttccttttcggccgagttgatccggatgattgccgagatcttactggcccggcgccagacgccgagccaaaatacgatcgtggtcgccctcaagaaggcggagaacccggaaatgctggcctacgtcttgagcggggcaatcatgggcgccttttactggtggcaagaaaacaactaccacgtcccgaaagcagaggtcgtcaccttcatcaagcggtcggtgcacgccctggtccaatagtttcaaaccaaaatcaattgagagagaggaaaagatcaatgtgggaaatgatcaaggccgaatttcggcatattcggcgtaatcgcctcctgttgttatcatttatcgtgatttgttttatccccttcttgtacagcattttcttcttgaagtcggtctgggacccgtacgggagcacccaaaacttaccggtcgccgtggttaacgaggatcgcgccgttaagtaccaggggcaaaccctaaaggtcggcgcccagctggttcaggaattaaggaagaataagcagctcaagtgggagattgtgtctaagcaaacggctaaggaggggctagcccaccgtaagtactacacggtggtgacgattccaaaggacttctctaaaaacgccgccaccgtcttggatcagagccctaagaaaatggagctgaagtacgaaactaacggctccttgaactacatcggccaagtcattagcgaaatggcgatgaccaagctcaaccaaaagatccgcgcccaggtgacccagtcctacgccaccacgatgatcaagttagtcaaacaggtggggaccggctttaatcaggccgccagcggggctaagcagattagcaccgggatggtgaccttaaattcggggaccaaccagtttgtcgccggggtttcaacggttaacaacggggtccaaaccctacaagcggccgtgacgcccctagctagtggcgccagtcaattggcttcgggaagtacgaccttagccagcggggttaaccaatacaccagcggggtgggcctgttagcggccggtttaaccaagttgagcgccaattcggcggccttaaacgcggggacggccaccctggccagcggggtcaaccagtacaccagcggggtggaccaactcggcagtggcctgacgaccttaaagaacaactcggccagcctgcgcagcggggcggccagcctgaaccagggggctagtcagttaagcaacggggcgagccagttaaacgccaccgttaacagctcgctgggcagcctggacttcaccgggatcatgtccgccatgaaccaggccagccaaatgaagagcagcctggccagcctccagtccggcttgacccaagcccagagcgccctttccgcggtcagcaccgaagcgaaccagttaaaaacggcttcgagtgccttaagtggggtcagctcggcggctagctccctgagcggggtggcccaaaacgacgccgcgatcgcccagtcggccgccgccttggcccagtcgaccaccgacgccaccaccaaggcccagctagagacgattgcccaaaaggcccagtccaacgtgacgaccatccagggcttggggacggctttaagtcaggtcaacagcttgagcaccagcctgagcggcctgcaaagccaacttaacaacctggctagcttacagacgaccttgagcggcgcccagacaactttgaatcaggccaaccaactgttgacgaccctgcagggctaccaaggggcgttgtctgccatgccaagccaactggcggccctcaagcaggcgactaacagcttggccagcggggcggccagcctgcaaagcgggatgagcacggcccaagccggaattaaccaatacacggccggggtggacacggccgctagcggtgccagtcaattgagtgccaactcagctagtctgaccaacggggctaaccaactccaaagcggggttagccagtacacggccggggttaaccaagctaacgccgggactggtcagttaaccgctaattcggcggccctggttagtggggccaaccaattagccaccgccctgattcaactcaacgccaaagtaccaagcttggtcagtggggtgagcgccctggctagcggcacccagaagttggtcgataattcgccagccctggtggccggaacggcgaagttaaacgccggggccggtgagctagctgataagttgattagtggcgccgaaaaggttaatgcggtgcaaccaagcaagaaggccgccaagatgtttgcggccccgaccaccgttaagcacaccaattacagctacgtaccaaactacggccacgccctagcgccgtacgtcttgtcggtggctctatacgtggggaccttgatctttaacttcgtctacccaattcgccgggtcgccttgtttggtcgtaaagccagcgcctggtgggccagcaagttagccgtcgggatgaccagcgtcaccgtgatggctctggcggaaggcggcattatgatgctgttgggcctccaagtcctacatgtgccgtcctttttctggaccctgatcctgtttggctgggcctcgatggccgtggtcatgttcttatcgatgaccttcgataacccgggccggtttgtggcgatggtcctcttgatgctccaactcgggggctcgggggggaccttcccgatgcaggtgacgatgaagttttataacgtcatccactggtacctgccgatgacctactcgatcctgggactgcgcaacgggattagcggcggcctgggagcacattacgtggccttttgcaacagcgtcttacttgcgatcacgatcgtttttgtaatattattgctcgtttcgatgatctacctacaacgccatcactacgccggcaagtccgagcttgacaataatcaagagctcctcggcccggaagcagacgatgacggaatgcacctcaaggaccgtcagtaaagcgtctgataattagataataaatattaataagcgtcgggacactcccggcgcttattcttttgtgtgaaattttaacgttaccaaattgttatcttgacgtaaaaaataaaggtgtttacccgtggtgctagttaattttttcctagaggaaaatgtctaaacatgttggtaaatcaacaaaaaaaacgcatatagtagtctcaaaactcccaagaaatgaggactacatatgcgttcatcaaaatataatgaacattatacagatacttttataacattcaaggaaattatgagaactgtttctaacatataccacaattgtgtaccagataagattaaaaaccgaagaaatactgattaactgaagcaacgcgatacagtgattattgcttgtgttatatggggcataattaatggctatactagccaaagagccacgtatagagcggtttgttccgtcttatttcctaatggtgactttcctagtaggagtcgattcactcgcttaagttcaaacttagcttacactatcaagattattcgatactttttcatcaagaagctcaccaaaggtgaactagtcggaattatagatagttttcctagtccattatgtaaaccagttagaaatagacaagcaaaactattgaatcaaatagccaaagttggctataactcaacaaaaaaatcttatttttatggtcttaaaattcatatgatcgttactaagactggctttccgattacttactcaatcactaatccaggtgtccatgacgtgaaagtgttagagactttatcggaagaagcgaatcttcccaatatcctaggggacaaaggatatattagccataaaatccatgaaaagcttgcccttaagggcattactatatccgttccgccacgtaaaaacatggataaatcagaaaaactagaccacagcttacttggaaaacaaagaaaaattaggttgtcaaaatttcaactcacgttctgttaaagggctagagagtagatttgaaagcatattactggcttacagtgttctattaagtcgagcacaacgacgttttgaaggaactttgagatattctttaggatcaacccaaaaaaagacctggagaacaccaacgttctccaagtctcttgcgttactaaactaacttaattactcatattgccccgttacgatattcatcttttgtacttggttagtggttgggttgtattggtacatccctaccaagctggcaacttgcgggtcaccactgttgttacggatctcaacttgatagctaccgtccgccttgggggttactaagtaactatcaccattcgcttggctaaccccgctagcggcgaagaacttttgtaaaactgacgtgtccgttgccgggctagttaccacgctactagaactagcttggctactagaagcggacgcaacgcttgcagctgccggtgtcgttggcgttgcctgtttagtggctgtcgcactagctacctgacgactagttgaagaagccggtgtgcttgaggtgctagccgcttggctaacgttagtggtgctacttgcggtactcgataccttggaactagttgcttggctaaccgctgaactagtttgaccactcgacatacttgccttttcactagtgggcttcttgcttccactatccttaaccaccttggcactcgatgccttggaacttgatgatgagggcgcactcgtgttgacgttggcgcaccccgctaatcctaaaacagccatcaacatcactgtgctagtaagaaccttgctcttaatcatcatagtcattaccccccatcacggtttattaaatttcctatttgtttacaaattaattgtaacacttttgcaataaatgtgtaaccaaatcgcaagaaatgttacttatttgttgaaagtgatggtgggcgcccgttttcagggcacaaaaaaacacgccccgcaggacgtgtaaagattgggcatgctgggttcgaaccagcgcattgtggattcagagtccagtgccttaccagcttggcgaatgcccaataaaagttttgcttggttaagcaacgatattaagtatatcaaattttgttgtctcgtcaaggtttttcgtcaaaatgattgttttccacccctaaaaatgggttacaataagctgcagagaaagagaggattattgatggctagtaattcggattcactttacaacgttttaaccaagctccagcaccacccggagctggtcatggcttctactgctcagtaccaaaatacggtctccttgctgtttaaggactccgtttccgttgccgacgccgcttactactttccggaaggccacctaatggtcaaccggctttcccctgactttgtcgctaaaaacggcgccctacttgatgactactaccaactgaccgctcagggtaaacctggttaccacgacgtctgggtaaccaccagtcacctccccaaaagaggggcctacctactggaactatcttatgagtaacgggggaaagatgcccctttacaaacgaccataaatcttgtaaactaatgcttgggtcttgttaattaactccccaaacattgattgcccgctggtcaaatcggttaagacgtcgccctctcaaggcggagttacgggttcgatccccgtgcgggtgacttataaagcaaaataggatgaacgccgttacgacggtcgttcatcctatttttgttttgagatcatcaagaatcactacggaggaagtaatcatggtcaaaaccaacgttttataccaacacggtaccctcgccctactggtacccggacttttaaagggaaccctcactagcggtgggctattggaacacggtgataccggtattggcaccggggagggactcgatggtgagttaatcatcctaaacggcgtggtctaccaggtccgcggcaacggtgaggtccgggtgatgccaaagcaagacacgattccgtttggtaatatccactgggccgactaccagtcactgggaaacgttgccgacctagaactcgaccaactagggaagcacattttaaagggccacagcgccaacacctttttctccgttgaagttaaggggacctttaaaaacgtaaccacccgggcggtcatcaagtctaacccgccgtataaaaccctcgcccaaactgcggatgatcaacgggtctttcaagctgacatcattgaagggaccttgttaggctacttcatgccgaccctgtacgccggagcggccgtgggtggattccattggcacttcttatcagacgaccacacctttggcggccacgtgctcgccgtcgggggtgccacgggtgccctaggtttccaacaatttgattcactggacctgcacctaccgacgaatgatgctgatttcatgaaccacgactttagccaagacgacatcctaagcgtgattgaaaaggccgaacagttttaattaacagaggggctaagagaaaaaccagttttctcttagccccttactgtattcaataatgctagacaggcaacgtggccaataaccacgcccctactgtcctatttagcacccttataaagttcgactaccgtattgatcatcgacaagaagttatcggcgtcgaggcttgcccggccaattaagaccccatcaatgtccggtttgttcatgatttgcttaatgttttcgggattaacgctcccaccgtagaggattcggatcttatcggccacctcgtaagaatacgagtcggcgatcgtttgccgaatcaagcggcacccttcttcggccaggttcgggttggcgtgttgaccaaccccgaccgcccagctcggttcgtaagaaatgataatgttttttacctggtcgaaggaaacgccccgcaagacgttgattaactgttcaaagacgtagtggacgctaccactaaactctttttgaatcatcgtctcatcggtacaaataatcggggtcatcccggcctgcaaggtggcgattacctttcggttaaccaaatcgtccgtttcattaaaaagcttgcgccgttcaatgtggcctaacaaggcataattaattccggcgtcggccagggccttaggacttacctcaccggtgtaggccccctcgtattcggcataggcgttttgcgaaataatttccagcggttggcccttgacctcttgtaacattgggtacagggctaagaaattggcggcgaccccgcattcgactaagtcggcatcgggaagccggccttgcaagctccggataaagtctaacgcttcatcaacgctcttgtgcattttccaattcgcgaccacaaatggtttgcgcatggttaatccctcgctttcgttgctagtggaaactctttgattattttactcgtcttaaactagcggtggcaagtacaactaattcccttcccgccatttttggttataatggaagaaatcaccgaggaggaatccgtttatggacatttcaaccaacttaattcccttagccgatggtaaccaaatgcccgcccacggttttggggtatacaaaattaccgatgatcaagaactgatcaaggccgttacccacgcctaccaggtcggttaccggctctttgataccgcccagatgtatgaaaacgaagccgctttgggcaaggccctcaaggaacttaaccaaccacgcgacaactacttcatcaccactaaggtcgcggagaaaaaccagggctacgatcaggcaatcgcctcggtcaaggaatccttagcccgccttcaattagattacgttgacttattgctggttcactggccggttaacgaacacttctttgccacttggcgggcctttgaagacctgaaaaaggccgggcttaccaagtcaattggggtgtcaaactatagcatgatccatctccagtacttggccacccaggcacgggaaatgcctgtcgttgaccaactggaacgccacccctggctacaagaaacgccgatgattaagtacaaccaggaacaccaaatcgttacccaggcctgggcaccactaggtcgggggcaattaatggaggaaccggttcttaagcaaattgccgaccaccacgaccgctccgtggcccaagtaatcttgcgttggcacctgcaatccggaatttcctttatccctaagtcggttcacgaagcccgaattagccaaaacgccgccatttatgacttctccttaaccgacgaagaaatggcgctgatcgcaagcctggataaaaatcaccggctcagtcaggaacccgaactagtttacgaatttaaccaacagtatccccactaacgacggggcgttgcttttttacccatcgggaggtgagtgccattcgtttccttcgctttttgatcacgcccctggtctatttcgccctgtttgcggccgggatctgggcctaccaaaataacgccacctttcatgaacggaccgacaccgttgtcttaaacctggagaactacgtccgggaactaacgggtcaagaaacgtcgaccaccacccaaaaggaacaccagagtcacacgagcaccattaacgagggcggcggcgggcgctgggtcaagaccagtgccaccttgtacatcgccattcaaaaccccaccctcaagagcgccatggaagacgccgtcagtcagtggaacggtaccggagcttttacctttaacatcaccaccgataagaaaaaggccgatgtgatcgtctcgacgatggataatagctccaaccaagccgcggggctaacccaaatgagcctcgacgaagccaccggctactttgtctccggtaagctttacctaaaccgggcctacttacttaatccaacctacggctattcctaccagcgaatcgtcaacacggcggaacacgagctcggtcacgtaattggcttggaccacagcaacgaggtctcggtcatgcaaccagccgggtcgaactattcgatccagccagccgacgtccaaaacgtccaaaagctgtacagccaaagcgctagtgcaagttccaccagctctactaactaagtttctcggaggaccccatgcaaattacccaggcaagcttaaccgatctcgagcaaattgtggccattgaacgggccggctttacccccgaagaggcgggaagtcgccaggccttcattgaccgcattaatcactttcccgaaacctttttggtcgccaaagtgggggacacggtcctcggttttatctgtggaccggccctagttggcgacgtcattgaggactggatgtacgaacctggcgtcaagtcagcttcccacccctcctcagtgatggtgctatcgctagccgttgccccggccaaccgaagccaaggcattggcagccagctgctgaccgcccttagtaaggtagccaccaacctgggatgtcgccagttgacgttaacctgtctggtcgaccggattcctttttacgagcgcaatggctaccaaaaccacggggtggcaacctctacccatgctaatgaggtttggtacaacatgattaagccgctttaaggccaagttagtaagtaatcttaatcgaaaaaagccggccaattcgccaaattacgaattagccggctttcatttagttaaggggcttgactcattgcagtccgtagcaacctccgtcctcgctcagttattaggtttaccaggaggtcacctcacccgcttacctgtgtaactcgattgccacccatagccacaagcctagaataaccaggcagtagactagggcggcgagggtcatgtaactgacaaagggccacgagccgctgatgcttaaaattgctagcaccaccgtagtcaccattcccaccgctagttgttgctgcaactggcggtaaagtttccttaaccgggccttcattgtcaattagtcgttaagagaaacaggtaaattatattttaagtagatctgacatgcctaagggattaaaatctgacaatataattaagaactcaatttttaccctttcaatatcagggtttacaaaagtttggattagcatatggtttgacagagaaattaatcatactagacaacatttcagtacagctccaatcaatttaaaattcaataaattggggctccattcccaaaaattcaaactagatgaaatagttcatgctgttgatgacccccaatttacacgtgaattagaagaatgtatgacagtttttaagcaggaatattactatcctgccgctgcagggcttggcggggtgatggaatcgctactttataagaccctagaaaattataaacgaacgagcaacaaagtccttggaagcgatcctactcttctagattatttaggtgcgcttaaaaaatttaatctaatcgatcggcgacaaagcaatagaataagatctgcttttacaattaggaactctatctcacattataatccaggttttactgaagtaagcgatattgaagcaatgcttcatggagttgaaaatatctatactactttatacttaccgagtctaaggtggaaagaatctcatccaaatcaacaacttcctgaaccaagtcgtcagaattaattattttattcaaaaaataatcataatagtagggctgaaattcgctatctctatggatattatgatgttcaatcaaattactttcatatctttcaataacttttttcaaaagattaaagtgtgaatttgacatattaatgttaaccattattacacctcgaacattagtttcttttaattatagcatttaaaatcagctggccatgtgggttatttatagaattacgtccaaccctgattggcgttaaaagctggtgggaggattatgtatgaaaaagataggcttagtttgtgccacactgttagtcggtatgtcactttcagcctacaacaatctggcgtcacagcagtcacataaagcaagcagtagttcatctaccaaggtagttgagcaccaccacaagaagcgtcaccaaaagccccagagctcgtccgtatcttcatctagttctactagtcagaccaatcagcaagcccaaagtcagtcttcgagcgtccaatccacccaatctagtgagagctcacagccagatgcttggagtagccagcagcaggctcgtgatcaggcggctcagaacgacggccccactactgaggaccaggcccgtgcaatgcttggtggtgctaacggcgacttgcaggcaacgaggacttccaacggctggacattttccggagatggctacacggccaccgtcggggatgatgggagcatctcgcataactaaagcatcccccgctggggcaaggggcggatataaattatttattggaggcaattatagtgaaaaaagaaattaaagttatagcaattccagatgatacaagaattatcattaactatggatatgaagatgatgtagatagagacgatttgccctttggtagtgaaccaaagtatgcaaaagttggtcaacaaatagttgtagaatcgaaaggcatggagttgactgaccccgatacgaatgaaccactaggtagttataaccctccaattgattacttagaaatcactgatgttcgtgataagtattcaattgctagaaagaaagtatcaaaaagccttaactcttccagtgtccctcctcttatcaaagaggcctcatcgccaaaatttaaaaacttaaatgtaaataactcagatgtaaaaaatatcaagcctgatccagttatttcagtgggagatattgttgaatttgttgattaacaagttgactaaaaatagactatacggtactataaaggtatctgagatgggtttcctagatgagacctgcgaaaaagagcctttctactgtatagtggggaggctctttttgcatgtctaaaaattttaagcatccgtataaatctttcgatgagcaaatagcaattttaaaaagtcgcggtgtggaaataaacgattacgaatttgctaaaaatgctttaatgacatttccatactactctattattaatggctacaaagatatgttcttgaagcaaaaagaacccgatatatatcgaacgggaacttctttcgaaatgttatatcaagttcattggattgatgttcaagttagcaatattatttttaaatactcactagcagtagaagaacggctaaaagcccttgtttcaaatatagtagctcgaaacttttctattgatgaagaaaagtacttagataaaagaaattacagtaaaacaagagcgcaacgtggcaaaatcagcgattttatgaatgcaattgaagatgctaagcaaagcagcaagatcgcccaacactatatagatgaagaaggcaatttaccaccatggatagcggcagaagttattagctttggctctatggtaaattggtattccaccttatcgattaacgaaaagaaagaagttgtaaacattttccttcaaagaatgccaaagcatgagaatgttacaactgactataaactgcaattctgcaaaatttgtttagaacaagtttatagatttagaaatctctcggcccatggtaatagaacctttaagttgcggcttaaggaatctgacacacaaaaaatacgttttttagagaagttctcaatttcgtttctttataaaactaagaacggggaagaattaccccgcaatgggcttttttcaattatagttagtattattgtacttctagacgatcaatatcttatatctactatgatcgatgagctggaatcagttgttaatacttatgggaatcaaaacctttttaacggtaaaagcatctacgatttatttgaagttgataaagattttatttcaagactgcaggaatttatgaacatgaaatttccttcatagaaaatgattttatgtccaaaccctgatgacataaaaagctgaaaaataaatagctgaaaaataaatagccctctccgaagaaaggacgcgattattattactcccaaagtattctttctaaaaataactccaaaggcgattaatagtattagctaaatcagcatcagctggatagtcagaatcatagtattttccattgtcatctaaggataagtaatctaagtctctctcatcccacaatagttgcaatgcttcagaaataactgatttttctttttcagtaaaaaacaacactatcacctcactaaacagcaattttctctaattataacaggcaataatctatataatttttaaattttacgtccaagcgtgattgacgttaaaagctattaggaggaaatcatgaaaaccacaaaattagtttctggaatcataatgattgtattaggcgttattgttttctttcaatccatgcttgccggtgtcggcaatgctcttgataacagcaattcgcacagcggctctgctggagtctttgttgccattctatatattgttatcggaattgtttatttagcaactcgtaagagtccaaaaatgggtggtgatattgctggtttagtaattgccatcattgcatggatgcttggcgcttttaatgttggaatctacaaagatcttcaagtatgggcatggctcattttgattattggggtaatgttctttatttggcattttattaccaatcgaaaaaacaacaattaattgttgcactttaggaggaagaatatgaaaaaattaactagttttgccatagtatgtggcctttcactcttaggggctagtaccactttaactcaaaccacttacgctaaagcgactcaaacaacattaggggctgggacctataaagtaggaaccgatatcaagcccggtcgttatactattacggctcaaaacggatctggaaatgttactggaagtaacgatttgaatatcatcttaggagatactactgacgatgacttagatcagattgattcctatactatgtaccttaaaaagggagcaaaagtaaaaattgatggtattgagtctactgattttactcctgttacgaaacgtgcatatcaaacggagctcaaagctggacaatgggtcgtaggaaaagacattaagccagggcgttacactattaaagctacttctggatcaggcaacttaacaagcaatgaaggtatcaatgaaattttaggaacagaatcagatagtgatcttgggcaagtgactcaaaccacccaaacgttacatcgtggtgaagtcttaaattccgatcttgaaggtattcagttaatcaagaaatagcttaaattacatttaagtgaataggttgactaataatgacgcttatgtaaattgattgaaaataaaaatcccacccgcgcaaagcgagtggggagaagttaattatgtatagccattataccacaagggagtgtgcattatggcgcaaatcattaaaaaagggccatcttacatggtcagggtgacttggcgtgacgaggacgggaagcaacataaaaaatcgaagtctggttttaagaccaaggctgccgctcgtaaagctggggcagaaatggaatccagcaagtaccacggcgttttatctactgccgatccgatctttaccgactactaccaaaattggtacgaaacttacaagcaccaccagtcgtcccgggcgacccaagatttctatcgctactgtataaacgtcgttaacgattacttcggtcgccgtaaaatatccacaattgatcgggctacctatcagcggtttttgaatgactttggtaaatctcactcaaagaacactgctagcaagatgaacgcttatgtcagagtagcggttaaaaatgccgttctggataacgtcatccccaccgactttaccgaaggaacaaccatcgtatgggataaaaccagaaccaggcaagttgagtatctcaacatggaagaaattaaccgtttggttgccttagtcaaagaatccctctcccccgggttcccagtccgctacatgattttgaccgccgtttatacggggatgcgactatctgaaattgccgcccttacctgggacgacctcaacctcccgtttaaaacgatcgaaattagtaagtcgtgggacttcaagggacggacctttaaagacaccaagacaaaaagctcccgccggattatcagagtaaaccaggaactattggaccgcctggttgaactaaaagctaacggtcatgatctcgttttcgcccgtaaagatggttccgtctgtgggagtagctccgccaaccgaacactgagactatttttagataagctgaacttgaataaacccggctttcacttccactcccttcgacactcccacgttgcctacctgctggcgaacggggttccactgtatgcgatcagtaaacgattgggtcattccaacatgactaccaccgccaatcgttacgcctacttaatcgatgaatttaaagcccgttccgacgatcaaatcgaaagggcgttggtgtccttaggtgtcccggatggtgtcccaacttcgttatttctatgatttcctatttccttatttcctgtcatatcaagggtttagcttccctatttatccttaaaacatcctaaatactctacaacaagtaatctcggccgagattacttgttgtagaattcaacgatcagggcttcgtcgatgtcggcgttcatgtcttcacgttgcggaagacgggtcagcttaccttcgagcttgtcagcgtcgaattcaacgtaagccgggcgagcaacaacggcttcaacagcacccttgataacgtccaggttcttggacttttcacgaacggcgatgacttgaccaaccttaacttcgtaggaaggaatgtcaacgcgcttgccgtcaacagtgatgtgaccgtggttaaccagttggcgtgcttgacgacgcgtggtagctaaaccaagacggtaaaccatgttgtccagacgacgttcaagcagaaccatgaagttagtaccgtgagtaccttccttgatcttgccggcgcgaacgaacaggttagagaattgccgttcggtcatcccgtacatgaaacgaagcttttgcttttcgcgaagttgggtcccgtattcggaaagcttaccgcgacggtcgttcccgtggtcaccaggagcgtacggacgacgagcaagttccttaccagtaccagaaagtgaaacgcccaggcgccgggaaagacgccagcttgggccagtgtaacgtgacataattgaattcctccaaataatttgtattggagtaaaataatccgatggtgaagctgacattcgtgcaggccaattggatcgttcaccctcgcagctgggttactagaaacaccaacttggcattggtctgttgacgagcttgcctcttcattgctgcattattttacacgtccactatcatacaacgcttaaatcgaccgggtcaagcaattctttgaaggaaaacggttagaaatccgggagttcaattgcttgtctggggataagtagggtaagattatgttataatcaaaagttaattaagacttaaaagtataggtgggattcggatgttacaagtgttaattgggatcattgcgattgccgtgatcgttgtcatcattttttacgtgtgccaacgacgggcgatgcgggtcattacagacttacgggcccggctggtggccctggaagaagcccggttagcacgccggttggatgacgccggcctcgctgacttaatgggggaatcgttgaaggtgttcaccgccttgcaagatgactacttaaaaaaggtggccccggccgttgacgacgctaacgaacaattagaagaggttagcaagaacctaaacgggctcaacatcttcaccgtgacgggacagttgaaccaggttcgggagttagtcgaagaggccgaacggcagcaaaagcgggtcgttgatcggctccaaaaggcggaccaaaaagaagaagagcaaaaaaaggcgaccgccacgatgggcgagcaactaggcgacttccaaaagaaactggatgacaccgcctaccagtacggggatgccattcggcccttgcgttcccagttagccgatctgcaagagcagtttacccgctttaacgagatcgccgccaagggtgatcacgaagcggcggccgaaattttaaccgacttaaaggaaaaagaggcccactttaccaagctggttgaggagattccagaactttataagccactatttaccaccttcccggaccaaattagcgagctgcgtgagggctaccgcaagctagtggctaaccactaccgcttcccggtcaacaatttggatgaccaaattgaaggcttagaggcgcaacggcagaccgccctggatcacattgccgccctttcgctagccccggtccgggtggccaacaagagtttggaagaaaaaatcgatcacctatacgatgtgatgcagaacgaaatggatgcccggccccaggttgaaaaattggtcggggtggttggcgatcacctagatcacgctcgccagcaaaaccgggagttgatggccgaattagaccgactgtccgaaagctacacccttaatcacgacgaggttgcccacacccgcgagctagaagaacaacttaagcagatccaaaaggaatacgaaaaggatcaggtagccgttaacgcccaagcggccgtcgccagtcaagtcctagaacgcttcatggaagacgaaaaggtcttaacggcgatcgaaacccagcaaaaggaaatcaatgatggggtggcctacctcagcgaagacgagcagcgggcccgcaaggccttgcaacgcttcgttaccacggtccgggcaaccaagcgccacgttgagaccctcaacttgccggggctaccgcaagattacctggactttttcttcctggtctccgatgaaattagccacttggccaaggacatgaaccagcaacggatcgacatggaggccatcactaaggaactcttaaaggttcaaggcgacgttagcgaattaatcgaccgaaccaacaaggtgcgtgactcggcggaactgaccgcccgcttaatgcaatacgggctccgctttgtcgatgacaaccaagagattgacgccgccattaccgaggcgcaaaaactctacgaccgctacgaatacgagcagagtttggaaacgatcggggcggccctcgagaaggcagaaccgggttccttcaagcgtttggaagacaactactacgatgaattagatgaagaagagtcatagataacaaaaggggtgcgacgctggtcgcgccccttttgctatccaagcccctagtgatctgttataattgatcggtatttggagtcgaacaggccattggtgacgcacgcaatcactctatccacactaatggcatatcttgcgttggtatccagcgcgtgtgaaaagagggaacacacaatgatttattttgataatagtgccaccacacaggcacgcccagaggtccttgcgacctacaaacaggtttccgagaagatttgggggaatcccagttctttacacaagctcggcgaaacggcttggaacctgctagaacaaacccggacccagatcgccaatacctttggcgttcaacccggtgaaatcctgtttacttccggcggctcggagggggacaactgggtcattaagggaacggcgcttgcaaagcaaaagtttggcaagcacatcatcacctcatcggtggaacacgccgccgttcgtaacgcgatgcaaagccttgaaaagttgggctttgaagtcacctacctgccggttgacaaggagggacgggtgaaccccgcagacgtgaaggccgccctgcgtaaggatacgatcttagtttcgatcatggccgtcaacaatgaggtcggcaccatccaaccaattaaagaaatcggtgcaatcttaaaggactacccgaccgtccacttcatggtcgacgccgttcaggccattggtaagggtttagacgacctggtcttttccgaacgggtcgactttgccaccttctctggtcacaagttccacgccccccgcggaactggctttatttacaagcgggccggccgtaagttagccccactgatcgatggcggtgggcaagaacgcggattgcgcgggggaaccgaaaacaccccgggtaacgccgccatggcccgggcaattcgtttaatgaaggaacaagaaaccacggatgtcgctaacgaacaggcggtccgcaaggccatttacgatcacatcagccagtttgaccacgtggaagtcttctccggcttaggcgccggctttgcccctcacgtgttgacctttgccatcgtcggggtgcggggcgaaacgatcgtccacgcctttgaagaacacgacatttacatttcaaccaccagcgcatgctcatcaaagaagcactcggaggcctctactttggccgctatgaaggtgccggataacgttgccacctcggccgtgcgggttagtttgggggaccaaaacaccctcgccgatgccgaagaatttaaccgggtttttgatcagctttacgccgggtttaaaaagattattgattaaggagaaccgttcatgaagtacgatgaaattatggtccgctacggtgaattgtccaccaagggccacaacaagaagtcattcattgaccgcttgggttccaacgttagaaaggcgctccaccaatacgaccaggtcaagattcacccgaaccaggaccggttgcacgtggagttaaatgggaccgacgccgaaccagtcatggagcggctcaagcaggtctttgggatccaaaacttttccccatccttgcgggtggaaaaggactttgattccgtggtcgaagcggccgtagcgatatttaaggaacaggtccaggggccgaccaccttcaaggtggaaaccaagcgggccgaccacaaattcccgatggggacctttgaaatgaataagcaactggggggcgcccttttgaaggcattcccaaccgacttatccgtggacgttcaccacccggacatcacgctgcgggtcgaaatccgcttaaacgggatttacctgaccagcgccaaaattttaggggccggtggtctgccggtcggcaccgccgggaagggaatgatgatgctgtcgggggggatcgactccccggtggccgcctacctagcgctgaagcggggcgtttccttagaaatggtccacttctactccccgccgtacacctccgaacaagccctggccaaggccaaggaattgaccgggaagttggctaagtactccggctcgatcaagttcattcaggtgccgtttaccgagatccaagaaacggtcaaggaaaaggtaccggagggctacttgatgaccgtgcaacgccgcttgatgttgcgcttggcctgtgccctagcccaaaagcgggcgggcttagccgtctttaatggtgagtccctggggcaagtggcttcccagacgatggaatcaatgttggcgatcgaagacgttaccacgatgccagtgctgcgtccggtgctgtcctacgacaaaaacgagatcatcaagatcgccgaagacatcgacacctacgacctgtcgatcttgccttacgaagactgctgcaccgtcttcacgccgccttcgccaaagaccaagccaaacctgaagcgggcccgctcatacgaggcgcgcctagacgtggaaggcttgatgcaacgggccttggacggaattgagatcaccgaaattcacgccggcgacgaattcttgaaccaaaaccaagacgtcttcgcggaattactataattgttagtcaaggggctagggaaccagttacggtttcctggcttctttttttgggctctacactaaatcttgttgatggattaccatagtggtgattcgttgacaggatctgtgttttcgtttttataagtgtcaacttgacaggggatagtaccctataagatgaagaaaaaggagagcgcctaatgggtaccgtttttcgccgtaccatcagcgacaaaatttttattactgctttagtttgcgcaggactgagttttttgattgggacgccacaatttaccgatattaactggaacacgattggaacgctcttatcgcttatgatcggggttcagttattacgaaccatgcatattttagatgcattaagtgattggcttttagtcaaatcacaacatactcgacagatgacgcaatttttcatcttacttgcattcggtggatcaatgattttgaccaatgacattgctattctaactttagttcccacctttatgacattaaatcgtcatcagaaggtaacaattgcttacccattaactctaatcgtgatggcggcgaatcttggaagttcatttacacctattgggaacccccaaaatttgtttctcgtgacatcttatcacattgatatgttaacctttttcaaattatcgactcctttgatgattgccagtctgattcttctggtagcgttaagcttgtgggtcccacgaaggtccttaacgatggtccccgcaaaatcaactaccattcatgttagtcaaatttgtattgcaactgccctgattgggtttattatgcttggaatttttaacttgataccgatttcattagttattattgttactattgttgttggtttgacagttgattggcatgtctttcaacatgttgattacgctttgctcttaacattcgtctgcttttttctttttgttagtgctattagtcacaactcctatattactcactggttaaatcagctaatgcaaacaccgcagagcgtttatattgctagcctaatgactagccaagcgattagtaacgttccagccgctatcttactggccaattttacaaagtacttaccagccttgttcctaggtgttaatataggtgggttgggatcaattgtggcctcccttgcaaatttgcttgcagtaaaacaattattgctgtttggcgaagaacagtcattatggcatttccttaaagtgttcactgtattaaatctgattggtttattaattttgggtgtttttggatggctttacttgttaatgtgagaacggtagccaacataaacaattaaagtttcttgaaaggtgcttttttgatctgaagttgaagtctcttaaccaaacaaactagacacaaaactcacatcaattttcaagtcaagtgcaacgatgataacgaattcttgatagtggtctaggctgttacgccatgcatcggtagtaatcgcatgggcgaagatagttcagaatacgtctgggacgatggttcagtgcggattggactgcttgaatttcaaccagggtaactgctctgagagacttccctttcgggaagaattccctaagcagtccattggcgttctcgtttgtgccacgctcccaaggcgagtacggatgtgcgaagtaaatctgggttccaacaatctctgataacttggcaaactcggaaccattgtcaaatgtgatactctcaaattccttggccccgtagtcgtcgatcgtgtcctgcaaggctttaaggcaggtgcccgcatgatagtcaggaatcttgacgatgatctcagtccggctgtaccgttctgtgagcgtcattaatgctggctcatcagctaagcgaatacctttgaccaagtcgccttcccaatgtcccacgcctgtgcggtcattcacggccgcaggacgcaactcgattgagtcgccgtatatcttcttattcttgcgattgtgggcgttcttatagcctttgatgcggcgtcggagcttcttgggaagtgtcatgttgtctagctcaagtagcccggcgtcgatgtagcgatacacagttgtcgttgaagggcaagccttgccctggtcgcgatagaagtgtacgaagctatcaacgctgtgtacgcgcggcttacgagtaagcttcctggcgagagccttgaagaacgcacggccggtcttaagaagggcgtagtgaccggttctatcgcgtttacggtcgtgcatggcttgggcagttcccgcaagatagacttgatgcgagtgacgcttcgagtcgagctgagttacagatccacgcgtgatttctcgtgagattgtcgctttactgcgatgaagcttctgtgcaatcacggtcgctaaaactgagttgttggtaatgcttgtgggtgttagtctgagagtgggtcatgaagattcctgctttcttgtttagctagcactaacaagaataggtcttcatggcctttttggtctagtcgtcagggtgttgcacttgaattgtaaactggggaggaacaaaaaaagcccacttagtttaaaactaagtgggtcaggaatattattaattggcttcgctcacaacaaagtcgaggggtgctaactaagttagcatctataatttagtacaagaagcttaaatgaagcttaaaaactaattctttgatttaccgacaaagaaagaaactacagcaacaacaattactgctccaataattgaaggaataattgccattccggctaattgagggccccaagatccgagtatagcttctccaatagaggaaccaactaatccggcaacaatattagcaatccaccccattgattttcctttgctagtaattgctccagcaatagcaccaatgatggcaccaataattaaaacccataaccaatgcatgaaacatcatcctctcttgtttttcgaaggatgttttttagatttgttatagttttgaatttctttagaaatggctaataaaagttgagatatagaaatgataattgatatttttgaccaaagtctaaatcttttcatatgaaatcctccattatctaaattgcatccttctaaatctaattataggctattgaatatttgcatacaagttattcgattgtgccattctttttaaaataggaatttttgatttgggtctgtactagaatttcggacagaaacataagagaattgatttatccgaaaggaatcctcaaaatgacctcctgaaatgtcaatttaagttagaaaaaaagttgtcgttgatcctctgtgatatgttccataaatacctcataaggtgtccgatagtctagtgactttcttggaattcgattccgcttactcatgagctggttcactaactcatctggaaggttgcgtaagtcacgatccttggtcaagccgtcgcggcgaagaaggccattgttgttctcgttgagcccccgttgatttggggcaccaacctcggcgaagtaggtgtggatgtcaaattggttggcaatcttccgccacccagcgaactccttcccgttgtcaaaggtgatcgacttgaagaagtggcggggaaacttacttaaccattcacttaggtggcggttgatgttctcagccttcttagcgtgaacgtttaggacaatttcgaccttagataagtgctcaactaaggtcataaccgtcccttaatggtgcttaccttgaacggtatcaccttcgagatggccaaactccttagtgtagttgggaaaatcttcatagcgctcgtagatactccgacctaattgaccagcctttccacgatgttccacatagccattagggtgacgattaccgtgcattggtaaatccttagcgtcaaagccaaactgaccccgtttaaacatccggtaaagagtccgtcgattacaactaatcgatcggtcgccacgcccaatgatggtgtcaggtgtccaaccttgtgccaccatctcattgatgtaggcaacctcatcctgcggtaattgggctagcttacgaccacaacgcttcttattgcttatgtactgttgttggtaatcgacaatcgttgccccagtcttcagatagcgatagacacggtagatcgtctcaacactacgcttaagctaagcatttgcgccaccttgtaggctttcgtcccctgagtgaagagatttgcgattgtagtgagttcagctgtggtaagatgagagtaggtcatttgtggtgtcctttcttttgtcgagaggtattcaaaagtttaccacaaatggcttttctatttttctaacttaattttactaacggcgcctattcaagcaatcgctacgaccaagattttaagaaaaatgcggtacgtttgagttttaactcttccaaaccagttaaaatcattgcctccgaacttggtgttcctgaaagtgccctgtatcgttggcggaagctatataccgaagatggaaagcaaacgccgtttgcttctttagaagctgagaaccgtgccttaaaacgtgaaaatgccgaattagcatcggagcgtgatatgttaaaaaaagccgcctactttgccagtctccagaagtaacccccagcgataagtatgcttttatgttgagggaaacctctgtttctgtggtaaggtgggcgcgtttgttagacgtatcaacgagtggttattatgcttggcggagagctttgccaaagcgaaacgccaaagaaaggcaatatcgtcaacgaatcaaacacttttttgatcaaggacagggcacttacgggcccaaacgcatctgcggtttattgcgtaaaaatggtaataaagcttcctatcaccgagttgcccgtctgatggctgatgccggtctgttgataatatctttgttaaactgattcatggggaaagcctccgtattctgattggtttttggcgatttcaatcatacggggaaggctttccctttttcaataccctcaaggtatcaatttacacaaaatattttacactccctaattttgcgttggtagtgaacaagtcttccagataatccgctttaaatggcactttaattcgcttggccaaaacgttaagcgagatcatcgtacgctccttaacgaaggaatagttagagccatgaacatagtctgcctgagggcgtttaaagtgaatcggcttccataaccactctaaagtccgaggaacagatttccaaacatgcttaccggtcttttcgtcaatcagtccggtatcgtaacgataagggtgctgatacaattgtgtccttaccgtgtcatatcgtgccttaacggttcgataagttgactgtaccatttgagagttgagctttggcgactcatttcgcagataacggtacatgtctttttggaagaccttttgattggcattaaaatgtccatcgaaataccattgactgacaatattgcacaggcgttgatattccttagttaccgccttaaatagcgctatttgttcatacgttggatatagtcgaattttagcagttagcgtttgttgtattgtacctacattatatcgcgatgattaaagtagttaaactaaaaagaacgccaacgggcgttcgtgaagagccttatatcccatgactaaagccacgggtattacggcttaggtcataataaaccgatgacggtaaggaccatcccgattcccaggagcggaccattaccaaagcattcagtcaagtcagctacccgcatggcgacgatgaagtttaagatggttagtgggaaaaacgatcccggccattagggggctaaagcctaggaattgttgcatggcctgcgaagttaaaaaccaaaatgggagcattgccatcatgaagcaaaagcgggctaagtaggcccccgaacgttgagcggaaacgaagaggcgtagtggcaccagcggttgggcggcggtccgttgggtgttgacgaaaactaagatgagcagaattccgactactaaggaaaccactttatagcggttccccactaagccatagacgactaaaaatgagcccgctactgagagcaaactggggatcaattcgagcttgaacgcccgacgactcgtttggggtaatttagtgacggcgatgggaagcattactaaggcgatgggaacgttaatgtaaaagccgattcgccaggtcaagaggttggcaaacagccccctagcactagtcataagctggccccaacgcccgccatcgccccgtagtaaccaatcgctttagttaagttgcggccttggtaagtatccgttaggatggcaaatgaggttggggcgatgatggccgcaccgatcccctgaaccgcccgcccaacgatgaggaggggggcggtttgcgctaaaccaacggccaacgaggccaagccaaagattaccaatccgacttcaaacagttgcttacgtcccacggcgtccccggcccgacccgctaacaagagcaagccgccaagggttaaggtataagcgtatgagacccaagaaaggagggcctgatttaagtggaggtcggtcgcaattttgaccgccccggtgaaaatgatcgagttatcgaccagcaacatgaagtagctgatcaaaaccatcgctaagattgctttgtgtttcatttcaattctccatccctatctaaaataaaagagctccctctcatgggagccgaagctagttgtttattgactaacgataattaaggacttaatggcttggcgttgatccattgcgtcataggcctcttgaacgtgatcgaggtcaaaacgcttggtgaagaccttgcccgggtgaatctggtcgtttaaaacggcgtctaagagcaccttacggtcgtgggtggttaccgaagcaatcccaccgcgtaggccaatgtttttccagaacagttggttagaagccggttcggtttgtggtaccccaacccggccgatgatggcccctggccgggcgatttggcccgcttcgttaattgacgaagtagcgccgacacactcaagcacggcgtcggcccccacaccattagtcaactccagaacctttttaacggcgtcgtcgcccttttcgctaacaacgtcagtcgcaccaaattcacgcgctagcttagccaggtcttcgtggtgggaaagggcgatgatccggctggcaccctgaagcttagccccgatcacggcgcatagcataggccaaccgcccgttaccaagaacggctaccgtgtcgcccggcttgatttccgcggtgaagccagcgtggtaaccagttgccatcacgtcggagagggcaagaaggctgtttaattggtcgtccgtgtagtcgcttggttaaccaggaatcttaactaatgaccaatcggcgttggtgtaaaggaggtattcgccttggtaaccaccgttgccacccgcttccatgttaaaacagtttccttcgcagccagctaaacaaacggcacagtgaccacagctatgggtaaaaggtgcgacaacaaagtcccccggcttgacagcctttacgtcggccccaacttcttcaacaatcccaattgcttcgtggccggtcgttgtcccagtttgacggttgctaatcccccggaaccaccagaggtcggaaccacaaacacaggcgcggacgatctttaaaacggcgtcggttggtttttcaatcgtcggacggtcaacttcatgaacctccatcttaccagggcccataaagactgctactttcatctttgtcataatcgttctcctttattttgttattacattaagccaattattgagatttgctgggttctcttggccaactaaaacgcggtgctccccagcccagtcagtgaaggtggcctcgaaatcaccaggattgccgacatcggtataaaaaggagccagtgcgcccttgaaatcgctgagttgggttaagaagacctttactggaacggcgggctaacccgaccagaccggtgaactaaccaagatcaagtcgtatcttcctaggtctggtagcggattaactaacgctaggtaatttcccgtcttcaattgttgagtagcttgatctgatgtagcgtacatatcggttaccgaataagttccatccgggaccgcaatttggtagcgatccgcgtccggcaagcggtcggcaatttggtccgccaaccgagctgtccgtcccgaccaagagtaggtggcaatcaaaatcttcattaacaatccccctcagccttaattattcacccatttcaatggtgaatcaatcggcctttccattccaatcgataagttaaagtgattaataaacgggccggtcctccccctgggtatctggatcaccgattccgaggctgtcgtgactacctatggttgggtccgcaatgatccggcagacaacatcggcaatgctttgccgggaggccgatactccaatgaattcgtcgtggcggtgggtcaggacgtacttaacttcgggtcggtcgtttaaccagggtagacgtagagttgtgtaatccaagccagattcttccagcatttgatcagccaaaacaggagttgtcccagttgggtcaccgccaaagaaatattcccggttccagcggccaaactcacctggcacctcgttatagagccccaacaagctggtttcaaccacccgggtaaagccgttttcctttgcggcagccagaatgctcttggttgggcggttggtatcatcgtggtcaaccaccgcgaccaaaccagatcggcgtccttagtggccttaattacgtcggtcggattagtaagatccccctccactactgttacccgcgggttctcagccaaattggctaaccggctcgcccgccgaagcatgagggttaagttaacgtccttgaacgcggcttcgtttaagattaggtcctcgacaaggtgggcgatttgaccattagcagctaaaatggttacgttcatttcttttcctccgttctataaaacatcgaccccaaggctgatcatacattcgacctcggtatagcgtcgtactaaaatctgagtgttttcaatggcgtcgctaggttccatcccgtgtatgaaaaccccgagttgtttgccccgtaagtgctggcccccatcccagaaaagccgttcgaacaaggtcttggcgatcgcgctaatcatgtgccaatagattggaatcccgattacgatcgtatcaacctggtcaatccgttcgatgattgctggaagttggtcaccaggtaagtgctgacccagctggtttaagtggtagtcaattaaatcgagttgggtaacgtccttccccgctaacaagcgatgaccgaggcgggtggtggtcccgtgagagtgttcactggcattgataaacaaaatcctatttgctgaggttaagtccatcatgatccccctttgctttgatcttgagcttagtataggcgccgaaccgaggaatgaaaattacttcaaagggaagctagtatgcattttaagtatgctgaagcgtaaaaaagagcctccatttatggagaccctgagaaaatagattttagctggctaggaaaatatcggcgcctctggcgcaattgtgagcgaaagctgaacaccagtaagatgatgattagcttagccttcctgcgaatactcttgaaaagattctaaacacgttctaaggttgacatcgagataattcataagaaattgttgacggtgatcggttcagccgaacgcccatttggatattggacagccctagttcacaaaaggtttcgattttaattcgttcggaataggttatactagacaaaagatcagctcctaaaagatgggtttgtggtaaacaccattttaaaggaagctgatcttttttgtccgaacagcgttcggattaattttacaatctaccttacttgatgttttcacagaatccgtgtattctcttatttaaagcaaaacctacttttattttactcgtttaaaagtacttggtacttttattaattgaagggagcttgcatttattatggataacacgcaacaacgccccacgttcatcttcttaattattggcacggcttggttatttgatgccatggacgtcgggttgctatcatttattatgcccatcgtccatcagcaatgggcactatctaattcacaaaccggcctgattagttcagtcagcaccattggcatggtctgtggtggattttactttggccacttagccgatcggattggccgcaagaataccttgatcgccaccttgctgacattctcaatcggcaacctgattttggccatctcaccaggtttttacacatttttaggcattcgcttcttcgttggcatggggcttggcggggaattaccggttgcggccacctacattgccgacatttacagggggactaaacgttcgcagatgctaattctggcagatagtttttgggccctcggctggttggtggcgtcatttttatcatttctcctaacgccggttctaggatggcggggaattcttgtggtaaccgcaatcgccggggtttttgcaattgttttacgaaaacacattcatgaaacagcaccgaagagcaccggaactcaacactggcttgttagtctgaaaaccacttttaaaccctggacactgatgctttggcttgcttggtttatggtgatgttcagttactacggtatgttcatgtggttaccaagtatcatggttgataagggctatggtatcgtgaacagctttggttacaccacgatcatcgtcgttgcccaattaccggggtacctctgcgcatcgtggttagccaagcgcattcgggtcaagtacgtctttgccatttatatgctgggaacggcctttggcgccatcatgtttggccaatcagcgtcagcccttctcatcgtgatttctggctgtgtcctttccttctttaacttaggggcatacggggccattatcgcattgacgccggaactctatgctcacaatattcggggaaccatgaccggcatggcgcaaggaattggccgcatcggcgcaatctttggccccctcttaattggggtcttaatggatcaccaaattagtattagtattatcttcgtcatttttatggtttcactgttgatcggttcgattgccgttttggcattgcccagcgctgatcagcaacctaacggggaggtcacccaatgaatcccatcgtcttaaaggaaaaaatcagcgaatttttgaaagaagatttaggtttcggggatctcagtgtcgcgtttctgccaggcggaacccccctatctggatcatttatcgccaagcagagtggcattatttgcggtcaagaaattccccaggcaacttatgacttactgggtcacgcaacctataaaccacgaattccggaaggcgctccggttaaggccggcgacatcattggcacagtttccgggacagcccaaaccctactatctggtgaacgggtcacccttaacttaattcagcgaatgagcgggattgccacccagacgacacacttcgtcaagctattggacgatgcgaccattcgaattacggatactcgtaaaactgctcccggcttgcgattatttgataagtacgccgtcagcgttggcggcggcttcaatcaccgttttgacctaactggtgggattatgttaaaggacaaccatattgccttagcgggcggggtgacccaggcgcttgcggccgttaaacggcatgtcggccccctcaccccagttgaggtcgaagtggaaaccgaagaagaacttcgccaagccgttgctggcggtgccaatgtcatcatgtttgataatcagaaccctgaaacgatcaagcagtggcgccagctcgtcccaaaaacgattaaggtcgaagcatctggagggatcaccgccgaatcaatcagcacctttaagggctgcggcgccgacttcatttcgattggcaatctaaccaacgacgtgacaccactcgatatcggttttctggttgccggagccgttaaaagttagcccaatacggttagcgcttcgcagaatttaaacagaccaattggagccttcactcgattaaatcgttgacggtctttatctttttattaagatttatcaataacctccgcgccattgctcataaactggaagtttgtcaaatggtgttgaaggatagtttctatcctttggagatctcctcgtgtgggagatcttttttgttgttttattagttgcggcgtttaatctggtgtgttgtctgaatatcgtacttgaaggcataacaaataagcctaccatcgtgacgttattgtggtagataatctaggcaatcagctggtagacgcgtgtgaacatattggcctgattggagaagccataacaagcacgtttgagctccttgatcttacggttgatgccctctatcggtccgttagagtaggacgatttggcggcgttaattactccattaagattctttcgtagggtatgcatggccgtatctaggggcgtgccgttaggctgatagttagtgatgatattcttgagttcatcagcgtgacgccccatcaaaatatcgtggagatcgatgtaggtttcataagctgttttgaaggccggaaacgtatcggttccaatatcaatggcgttctgttcggtcgagtactcattcagaccgaagaggtagcggctcttttgtgcgtcagggttggccttgtggaataggcgccatagtgatttcagtactttatattcccgcgaatgcttgtcgagttactttaaacattgagtgcgaatggtacccatcgtccggcccattaattgaataatgtggaaccgatcaataatgagttcggcgttagggaatagttcgtgcacgaatgcctgataggaggcgttcatgtccatgatgacgcgttgaaccgcggcccgttctgcggtgctgtactgactaagaaagaactgtttgatggttctattaaggcggtcgctaagtactttaactgatttgtgagtgtcggcgtcaatgcaaataaacgacatggagccgtgcgtggaacggaattcatcaaagcatagattaatcggtaaccggcggctcgcgtgtggatgaatattagccgtcaaaatacgctgaactgagtttgtcgaaataccggtgagactggcgatagtcttagccgggagtgatttactggctagcttcagcacatgagtcgctagtccgtgaccgatggcgtggttggttgataccactggagtggtggccgtacaagtgctatggcagttactacaacgccagcgttgcttgtttagctctagaattacgggccggtccatgggtcctgcaatgtggacatgagtgagcttgtgtccgttagggtgcaacgtattgtatccacagctgggacagcgcctgagtgtgtaggtaagctctgcctggatgaccaaatactttttgcgacccgagccccgaccatgaaattcctcacgagtaccgaacacctgaatgtttgtgtctgtaattcccagtaatttaagtgtattatctagttgagacatctattcctaccccgcttatcttgagtttcgtcgcttaaagcatagcactagggaggcttagatgcctttttttgttatcaaaaagggcctagtacttttggaatggaaatactttccaacaccaaaaattctagactcaaaacaattttgaaaataaaaacgatcggcctagttattaggttgatcgttttttaatttatccggtttatgggcgttgacatagtcagcgaatgtttttaaaagttcttcggtttgttcaattgagaggttattagcttgaaagtacttttctaataaagcccctttttgaattaatcggcgagaacgggcttttcgtgcttgtcgattttcataatacttagattggcgtaacttaaaatcttcccgctcaattttttgttttaaacgcgcttgttgttcaattagtttttcatattgattaggcatggaattccccatctcctatgactaagaacgtgtttagactcttttcaagagtattcgcaggaaggctaagctaatcatcatcttactggtgttcagctttcgctcacaattgcgccagaggcgccgatattttcctagccagctaaggtttttttgtttggcctagcggtgacgctgggccttttttgttggaaagctgtacttaaagctggccaagacgtatggcacgatggccaccgttgctagagccacctggtttgtcagcagtagtgcgactgccaaaatgaatagtgctccgtatgcaagttgttcagccccgttcatgattaatcctccttgtagtgttcgttcctcaacttcatctccagcttgtgcactcgatctgtgagcataacccggtcaacgatcatagcaaccagaaacaccgctaggatcacggctaatgcggtcatttcatcacctcctctcacggcattttagccgtccaatcgatctcatcgtgatgtttgtgcatccatgctctcgcatatggcaggtaaatcttagttaccttgccagtaccatgagcgccgacaacccacgcttttgggtcgccgttttcgatctgaacctcagggaactgatcgaaaatgtatagccggatccagctcttagctttgccggcgaacaaatcagcccggatatcctccagcttggcccaatcttgatcaggcttagccgaagatatcagcggtgcaacctgtttggccaaactaagcagatcctgctcggttaatgtgatctccatcgctataccctcctcttttcgatttatacttgaatcaactcctagcgaaaggaggtgattaatttgtctctctcaaaagaacaagcagcgtgcttaagattagttcaacaagacggcaaagctgctgctcgagaaatgtacaatagcgaaaataaaatttttcaagatttatacagcaacaatttctttaatagcaatgtgggagtagttaatggtgaactagaagtggttgatctttcgctatcagctaaaggccaaaaagaactttcgctatatatggaaaacaaacgagccgaatttaagaacaacttcgcatttccattgctagtcagcattgctagtgccacaatcggtgctctaataacttatctgttcatgaaatagaaagttattaagcttccaagagccccacctataacgctaaataaaattgtttttaggatttgaataaatatttttttattcataactaaacctttcgttactaatcaagatcattcagctgttttattagtcggacgcggaaaagtgatatttttagccattttgttaaagatctttattgactttttcgctttatttttaggagcttttttaagctcctttttcttttgctctgccattttcgttctctcctacagtcctaaatcgtcgtcttgaatctccaatgcgttgtcctggaacactttcagcgcttcaggaaagtaccgccaagctccatcgtgatcgcggtagctcatatcggcatcgcgcttaacgcctagcttgttggcccacttgccaattgcgatcggcgacacgccaatgatgttgccaatctcggttgctgaatactctcggcgtgcaccgaccggcagtacttgcatggcgcaaattgcttcgttgcggaagtcggtggccatacgtggtcgttggtaatcgtcagcaactttgccaagttccagatacagcttgacgtcttgattgcgtaactcgtgcgccttgttgacgttctgcttgcgcatttcaatcagccattctcgcttgtacgcgagcttttcatgctccaggctactgtcaattgcgactgtcttaccgttatgttcagcttcatattcgttgaacagtgatacgtacgttgcggtgaagatcgtccctttgcgtccagtcattttattggctacgaattcacatccctgtttagtcagcagatagcatttgtaattcttgccagtaccagcttgatagcttgattcaatgaagaatcggtcagaatccaattttggattttgatccaaaacctctttatagctgtcaatatcacgcatcaggtgtgcgtgagtcttgccaatcatcttggcaacgtcccgactatcgatcacttgttgtttggattcaccaacatagcgaatcactgagtcagtattaaaatgttccatcatttatcctccttgtcacgtttcgtgatattactgccaaaaaaaatatgttctacgctgaccccatagtagtttgctatcgccatcttagtagcatcactccctctacggtcaccagtttctagcattgccagcattgattgtgtgataccaatgtttttagctgcagtcttttgagactctcctcgctttcgtcgcagttctattaataccttattcggcttcgccaatttatcgcttcctttgtcacatactgtgatttttatcacggttactataatatatctcttttcgtgagatgtcaatcacaaaaagtgattatatcacctgctttttttatcactattagtgatactattattacggaaggtatttataccataaaagatacttaaagtgaggcgagcaggatgaacattggtgaacgaattgcacaactaagaaaaagtagaagcatgtcgcagttccaactagctaagacgttaaatattgcaactagcacccttggcatgtacgaaacaaacaagcgaaaaccaaacatggaaatgttagaaaaattagccgacttttttggcgtgtccgttgatttccttctaggtcgtcctgaaaaagacgatctcaagaccgcagatctcgccgacgatgacaccatctttacttacaaaggtcagccactttctgacgacgacaaagaaatcatccggcgcttgatgaatgggaagtaaccaatgaacgattgcattgagtacctagtgaacctcgcttttactcgaggaatcagcgccgtcttgactaaagaactaagcccagatactccctcatgcgccaacgctaaacgccgaatagtggttattaatatgaattggaaccgccaagaagaaatcccgttcacgattgcccacgagattgcccatattttgaatgaagataacggcgtgcgctattactcctctaataccgtcagaaccaaaaccgaagctgcagctaaccaaacggcaatggatcttctccttgactactgtaacgcttacgacattccagttcctaactcagtggcgttttgcgagcagtttgggatccctaccgagctggagtatatagcctgccttaaaatcaaacgtatccttatcagctgacagtgctggttacttatacggttacgtccaaacctgattgacgttaaaagctgctattggatggaggaaacgagaaaatgtcatatacgctagatgaagtcaaagcccagatggaagaagttggtatccatgacctgtggggaacgaagcgagaagccaaggaacttcctaaaatcttaaatgacgatgaaaatgaagtgattaagtatggttgctcgggtctcgctgacggtaacactgttttggcgatctgtaccaaccatcgggttctttttatcgacaaaggcttgatctatgggattaagtcaactgaaatcccattagatatggttaatggggtttcgtacaagaaagggctagttatgggagccatcgccatcactaatggggcaacggtgaccaagctagaaaacatcaaaaaaaaggatgctccggttatggctgatacgatcaaacaacaagcggctttatacaagcaatccttacatgaccaagctcaaccacaaacagtaactagtcagtctacgtcgtcatctaatgtcgatcaagtgatcgaagatttgcataaacttaaaacgctggttgatgagggtatcatcagccaagaagagtttgaagctaagaagaagcaaatgttaaacatttagaaaacaaaaaaggctcatccctactgccatagggatgagctaaggagttgaattgaggcgtaaattgcgaccttatcagaccattcaactcctccagtatatcataaggatatacgaacaaataaaaaagccctctccggagaaaggacgtgatgaaatatggataatttgctacaagaaattttaaattgggaatatggatatgaagacgaaaataaacttaatgcatttctagaaaatgctaaaagctattatcaggaagaagttgcaagcgctcatctagatgatgacgatttaatatatttctcttgggctaggcaacccctgcatatttacctgattaggacgtcgggcaacttagattttaatcaaatattcgtgatggcatcgcaagaagacgatttgttaaaaaatgaaatcacctatattgataaaactgaggagacaaataatgctcaatttaaacattcaaatgaagagaaaccttaaaatcagggcttcccctcgttgacaattgtaaacggtgctcctatactaaagccaacgttaagatttacagttgtaaacgaaggaggggagccgaaatggtagaagtactcgtcgccattgtgggcctagtgttgatcgccctgatcgtctggtggttctttggtaagcaccaagcacaagcgggcaaggccgtgatggaaggggatcaccaggtggcgaccgtggtggtcaacggggggtattcccccagtaccgtcgtgttaaagaagggcgttagcgggtcagtcaaatttgagatgcgcgattcgaccgcctgcctgtcgcacattgtttttgaacagttagggctcaataaggatttaaccaagcagcccaccaccaccgttgaaattcccaccgaccaagcgggggaatttaatttcgcctgtggaatggatatgttccacggtaaggtaatcgttaaataaggaggaactaaccatgggattatttgatcgttttaagaagccggccgtcaacgaagacggccaacaagttgttaaggtgaccgttgacgggggctaccaaccagaaaccgttcgcttggctaagggggtcccggccaagctggtctttgaacgggttagcgacaaggggtgcttggaagtggtgcactcaccggaactgggctttgaagccgaactaccccttaaccaagaagttagcttcgacgttaagaccgaccagcgtggcgaatatgattttgcctgtgggatggacatgtttaagggaaaggtcgttgtaaaataatgaagcatttaaccagtttgaaacggttctgggtctgtttgattctgacgctgccaatgctggtgcaaatggtggcgatgccgtggggctggatgatgccgggctacaactgggttgccctggtcaccaccactttgatcatcgtggtcggggcctggccctactggaagagcgcctgggcagcctttttacagcacaacgccaacatgaacaccctggtggcaatcgggacggcggtggcctacttctacagcctctttgccatgctaaccgggcgggaggtctactttgaatcggccgcctttatcaccaccttcgtcctcttgggcgacgcgatggaggaacggatgcaccaaaacgccaacggtgccctcaaaaaactgctcgacttacaggttaaagaggccgaggtcttgcgtgatggcaattacgttaaggtgccactagaccaagtggtggttggcgacttggtccgggtgcgccccggtcaaaaggtgccggttgatggtgtgatcaccagcggggtgacgacggttgacgaatcgatggtcaccggtgaaagtatgccggttcaaaagggggtcggcgatcccgtgattggttcaacgatcaaccaagccgggacattccagtttgaagcccaaaaggttggcgccgatacgatgctctcccaaattgtcgagctagttaagaaggcccaaaccagccacgccccgatccaaaagttaactgaccggatcgcccaggtcttcgtgccggcggtcttgatcattgcgatcgtcaccttcgtggtctggtttagctggttaaaggcgagcgccgtttccgcaatgctcttcgccgtggcggtgatcgtgatcgcctgtccgtgtgcgttggggctagcgacgccaacggccctaatggtcggaaccggccgggccgctaagcttggcgtcctgatcaagaacggggaggccctggaggcggtcaatgggattaagacggtcgtctttgataagaccgggacgatcacggttggtaagccccaggtgaccgacgtggttggtgcagaagacaccctggcggtagcggcggccttagaagacgcctccgagcaccccttggcactggcgatcgtccaaaaggctagggaagcggggctgccagtcgaaccggtgacagactttaataacgtcgccggcgaaggggtaacggccagattggccggccaagttatccgggtcggcagcgcccgcttaatggcgggcctggcctacccagccgaactgcaagcaagggaacgggccctccaggatgaggccaaaacggtcgtcttggtggccaggggcgacgccgtgattggcttgctcgccattcaagacgttcccaagccgagctccaagcgtgcggttgaagagctcaaggcccgcggcttgaagacggttatgctaaccggggacaatcagcgggtggcccaagcgattggtgaccaagtcggaatcgaccaggtcatcgcgggcgttttaccaaacgaaaaggccgatcacgttcgggcgctggagcaaggtggcccggtggcctttgttggggacgggatcaatgacgccccggccttgaccagtgccaccgttgggattgcgatgggcagcgggaccgacgtggcgattgaatctggttcgatcgtcctcgtccaaaacgatttaaacggcgtggtcagggcgctggatatgtcacaaaagaccttcaaccgaatcaagctgaacctcttttgggccctgatctacaacctgatcgggattccgattgccgccggggtcttcgtggccctggggctgcacctgagcccggaggtggccgccctcgcgatggccttctcttcggtctcggtggtttcctcgtcactcttgctcaatcgaaccaggattgcgggagtgcaaaggaaagtgtaataacaaggattgggaaaagactggaaaggaggtcccttctggtcttttttctgttacacagataacgtgctcccaaccacgggcctagtgtctaagtacggctgaagaacgatgccaaggcatcaaccttcagcctatcttagccatacggcccgtcgagaaggttggcttgcacttccaccctgccgctgggtagccctgctgatctttaccttagcggcccgtcacctggctaaccccttcattgccaccgtctacgtcttatacatggccgggatggggacttgcatgggttcggtaatgaccagtgccttgcggacccttgccgacaaccaacaaacggaaggtaacgcgattttgaacaccctccagcagtttgccggggcggtgggaacttccttaagtgcggtggtggtggcccagagccaaactcacttggcgggcagccaggcctacacgaccgccgtggggacccaaaacgcctttatcatgttgacggtctttgccacggtcatttggtttagctactttaaagttgttaaataaaaaaacgggcaccgtcctggcttgcgtcaggggtgcccgtttagtctttaaaagaccttcatgtcggtccagtgggtcgggaggttgttgaagtcgtaagtggctaggccctcttcaatctgatcgccggtaaacatggcggtgtgggagcgggccaacattaagttgagttcgttatcggggtggaactgggccatgacgaccgggatgttccaagcccaagcggccccgacctcaaagatggtgccggcgtctggttcggggttgccctcttcgtacttgtagtcggtgatggccaccaccacgtcggcacgcttgacctggcgcatgtcggtggcaaagaccgtgtcctgccagtcgcgggagccaaactctaagccctccgcttggtgttcttgggggttgtaaatgccctccggatcgatggttgggttcttcttgagggctgccattacgatgtcaatccgttccttttgctccggggagaagaaggggctagcgaggtaaactttgttttggtacatgggagacgtcctttctgatcttagtagttctattatagaagaagtgggtacaaaatgcaggaaagaatgggtagaccaatttggttttatgcataattggaaggggcggttgggtgaaacgggagcgccccgactaaaaagggggacagaaagttttttgcgaaaagttgggaattacacttgcaatttggggtgagggtctgtatagttatatatcgttgtcaccgcgaaacaacgcggtgctgatgcggttgttaaaaataacagttgacatcagttggtaactctgatatagtataagagttgctgatgcaacaggttaacgatgctgctcaaagagttaattcaaattaactcttgacagttaaaatgttaactgatataataaagaagttgattatacacattgtgagttaatcgacggtagacctttgaaaactgaataatgtttcgacgaatcaaatgtgtagggtccttgatctgatgatcgaggcaacaatctgcctaattataggagacatttagagaaatgtgaaatgcttattatcagcccaacttaataccaaaagtggattgcctttagaattttacataatataatttaccccaagccgccaaagtcgatttgatccagtaagtcttccctactctgctggtcgagccccaagtaggccaaggtcatcgcctcgctggaatggttgagcagcttcattacgagtccaatgttgtaattggactgtacgtacacccggtaagcaccagttttacgcatcgtgtgggtaccgaggtagtttaagccgagtaaatcccccaccttgtgcatgactttatagtactgatgctcggtaatgtggcgttccgggcgttgaaaggagggaaaaagccattcgctggtataaacctggcagtccgggttagctaattggtagttagtcaaccaacgggcgtagcgcttgaggtctttttcgaccggcttcaaataaagggtgttttgcttgtgggttttcttgtcgacgatgaaggcgttgcgtcgtacctccccttcttcatcaaacacgtcagccttttttaaactgataacgtcggacacccgcaacagggtcgccttcccgacttggaagatcgtgtagttgcgttgaccaaacttgaaattgtcacgcaaggtcgctaatacctgggataacatctgggagtccttaatggggagtaccaactgcttcaaaagatcacttctttcctgggggctgttttttagctatcctcaattatagtccccatcaccaaaaccgtcaattttagatcctattaaaacggcattctcgggggcctatttgtatattataggccccattttggcgccacaaatccccagaacagtaaattcgctctcagacaaaatttcagtcgggttaatgggtacttgtccgtttcattatcgctgaacgtcaaatcatttaattaacataatataatttaaacaacttctcccctactaaaaaatcccccgctaagggaggattacagctggtgtaaaaattgactcactacttgattgaagacggctacctgttcggccatgacgacgtggccggactggtcaattgaaacgtgatggaccattgggttatccttagccaccgttgcgtaggctgattggtaaaaggggctttggttggcggtcaccaataaggtcggcaccttggtggttgctagggttggccggaagtcttggcgcgcgacgtcggtaactagttcccggttggccgcccggtcgaaaggaaactgctgtttaactacccggagttggtcataaacgtgttggtcgatgccgtgtagcgtttctgatacgccgggtgcaagtagaccctgctggtagttggcacgggtaaccttcatgaagccatagggccaagatggcgaattaatcaggcgcgggctctggtcgacggccactacccccgccaacggatagttagggtaccgggttaagaagtcatagatgacactagcccccattgagtgaccaatcaagatggggtagttgatggttgacaaagcgagtaactcttggaggtccctactgaggcggtgaatgctgtcgaggttgggatcaaactgggaggaaccgtgattacgttggtcgtaggttacgacctgatagccgcggctggtaaagtattcaacttgacgcgtccaaacttgctggtagccaccaaagccgtggatgaagatcaggctttggccgtaaccaacgacttggtagttaaggcggagtccatcatcagttcttagttccatgatcattatccccttccatcacactggccaaaaagatggtggcaatcaggaggtcggccgccccacccagactgaggtggcggtcagaaaagtccttctctaggttgaccaagaattgacgaccttgtttcgttgttagaccaccgagctcaaagaaacggtctaactgttggtccttccatgctaagatggctgggtccccagcccgcttaactagggtcgtgtcatcggtgtggcgggcaatcttcaagaaggtggttagctggcggtcattttggttcatcccccagttagcccgccaggtcggcaggccatacttgaaaacggttgggaaaccgctcgccgcttccccccggatcccggtttgcccgtaggctaggtactggcgctccccggcggtcagctgttggccatgctttaagccatccaggtcggtcgccaataggttagccaacatctctttgacaacccgttgaacgttcaactgggtaactggcaactgacgccccttcagcgtcgccacggttccggtcaaaatgcccagcgaaaaaatggtgcccttgtgagtattaacccccgctgttgctttgaacatcgtcgtgtcggcccgctgaccgaggaggcgaagttagttaaagaaaaggggcgcaggttgtccggtcgggaaattgaggctggccgtggccgcctgcttaaagtaagggcgtagactggtggcgctttgaataaaggtgaagacatccatatctgggtgggcgcggtgctcaactgggtcaaccaatcctggtttgggccaggtgacgacttcgtttaacattgccttcaccgcttggtccgccagttgctcagcaacagtctcccgttggttagccgcggttgcttcgtcaattagtttggccacccgggcttgtagttcttcaacgctgtgacgccgtgaccgtccacattccttagccgggcgcccgcagattagacaggtccgaactggaagatcaaaatccccccgcgaaagtgagtgggattccccgccgttggtgattaacacatcgaggtcaaagagccggttggctggttggcgctcttcgaagtggacggtcccctccttgacgtttacgccagcgctatataataggtagaaacgttccggaccggttggagcaacctcccaagaagtcgcaatttcaaagggttgtccgcacgctagccactggtcctcaaggcgtgctaagccggcggtaaagaaggcttggatggcagcgctgttcttgactggccccgggatatttagcttgcaggcgaccaccacctgggaagagtgttctcttaataactgacccgccggtcgcggttggctaagaccgctgggatctctacatcggtcccttcaaataccttgctcgccattgttagttcctcctaattatattatgtaaagaaaagggtaccggatcaaggtaaccctattctgaatggcaagcgaccgaggcagattgccccagccactcactcggatatgtcatttaagattggcagtttcggcgcttagtccttaacttgcttgatagcgtcaattaggctaccgtcacgatattcgactaggccgacgacgcggtcggtgtattcaaccggtgctggcttgccaaccgtggcttcggcccgcttttgcagttcttcaattgaaacgattggtaaacttggcaccttgctgaaggcgtcaacgaggtcttggcgagccgggttgatggcgatcccgacttcggttaccaggacgtcaacggatgcccccggcgttgaaacggagttaacgctaggtacaaccgtggcgatccggccctgggttaacggcgctgagatgattgtcttcttggtattcatcgtcaacatccagaaagaaaatcttcttggacgttccgtctttaaacgtaacggtcacccaagcccgtccatattcccttaggaggtcatatatttcagtatgtgtgtcgatcatcatctttattcactccccagtactacttaatattctgtcacagaatggttgatttttaattgccttccatgcatttgtgttagctgaaatcgcttgatgcattgcctgcatggagttagccgcctggacagtatcaacggtaattcgggtcgccatttcgttttgaactttagccatctttacctcctttctgcaaaataaaaaccggccaagccggttgcaagttatttaaatatttgtctgagcgtgtatgcgatgcattccaagttgaatttaatgaacttccaaattaaccatataaatggccaacctaccgctataaggcacactaaagcgaacttcgttaaagcgataaccatgatttgttgaggaaaaaatctgaccaaataccgcgccgaccttacagctcttaacgcagaaaaaattggcagccaggctcacggctatgtagaattcacgactgaggctgacaagctccacatcaagctggagatgttcgacaccccggctaacatccagcactgggaacacttccatggcttcccggatggcaaggatgcccaagtgccaacccttgcccaggacaccaaccaggatggctttatcgacctcttggaaaccgaaccagtctccggcacgactatggtgcccctggacacggctccgcatgaaatgtgcatcccccacgacaactacccagttgccgacgcaaacggctactacagctatgaaaaagatgtcgacttagccaagctggaagccaggttcaaggaagtcttcaatgaccaggacctggccctggacaagcgggtggtctacatccacggcgtgccagctgacctggaattgccagaaagcgttggcggcaagatcaacgaccattacgaccaacacgtcactcttccaatcgcggctggtaaaatcaaccgcgtcgactaaaactaagccattcagaggatcaaattcccctggatggcttttttcgtaaaaaaatttttgtaaaaatcccgatcttgatagaaatcaattggggaatcctgctttcccggtatattaaaagcatcaaagcaaggaggtcaaaagatcaatgcaaaaatggttaatgaaaaatcgcaaccggctgacggcaattacgggcatcttaatcgtcctggcctttgccgcaaaatggttatttaaaagtgaaacagcagagtccggcctgctcctggccgcctccctcatcggcggcttcccgatcgccgcatccgcttggcaggccctgaaagtcaaagtcatcagtatcgacttgctggtgaccctggccatcttaggtgccttcgtcatccaggaattcgaagaatccgccatcgtggccttcctcttcttgtttggggcttaccttgaacaaaggaccctggccaagacccggtcagccatcaagaaactggtggagatggtgccagaaaccgccctccggcagacggcagacggcgactttgaagaagttgacttagacgacctggacgaaggggacatccttttggtcaaaactggcggcaagatcccggttgacggggaagtcgtctccggttccgggacggccaacgaagccagcattaccggtgaatccatgcctttaggcaaaaagcccggcgacccggtctatgccggtactattttggaaaacgggaccatccggatcaaggcggaaaaagtcggggatgaaacgacttttggcaagatcatcgaactggtcgaagaagcccaggactccaagtcccaggctgagcgtctaattgaccgcttctccaagtactacaccccagtcgtcctgctcctggccattattgttggcctcatcagccaagacctggaactggctgtaaccatcctggttcttggctgcccaggtgccttggttatcggggttccggtctccaacgtggccggaatcggcaatggggccaagcaggggatcctttttaagggcagtgaagtcatcaccaagttcagcaaggtcgacacgatcatgttcgacaagaccgggaccttgacttacggcaacccccgggtcagccaggtgaaaaagtacggccagggccagctggctgaacagcttttggtcagcgtggaaaaagaatctgcccaccctttggcgaaagccatcactggctactatgaagacctggaagctaaagaagttgaagcttcccaggtcctccagggcggcgggatcgttgctcaagtagctggccagcaggtcctggtcggcaaccgctacttgcttgaccagtaccatgtcccagttacaaaagaaatggaaaaggacatggaagagctggcaagtgctggcaattccctggttctggtggctgtaaacgggcagctggaacttgctttaggcttaaaggacgagatccgggccggggtcaaggaagacctggttgctttaaagaagctgggtgtcaagaacctgctcctcttgtccggtgacaaccagaagacggttgacctggtagcggaagaactgggcctcactgaggcatatggccagcttttgccagaagacaaggccgaatttgtcaaaaagcggcaggcagccggtgaaatcgtggcctttgtcggcgacgggatcaacgacagtccgtcactggcccgggcagacatcgggattgccatgggcagcgggactgacgtggcaattgagacttcaaacgtggtcctcatgaacggcagcttcgaccggattccgcgggccctggccctggctaaggccacccggcggaacatgattgagaacatcaccatcgccctggctgtcgtagccgtcctgctggtcagcgtgttagccagctcatggatgaacatggccatcgggatgtttgtccacgaaggcagtatcctggttgtaatctttaacgccatgcgccttctggcctaccggtcaaaattacaaaaatcgcgaaagttgatagaaaacaattttttctcaagcaacaggcccgtatactaagggcagcgaaagtatccaatagaaaaaagaaaggaaaagaaatcatgcaaaaagcaattttacaacttgaaacattagcctgcccgacctgcatgcagaagatcgcgggggccatcgccaatgtcgacggggttgaaaagaccagcgtcaaggtcctcttcaacgcaagcaaggccaaggtcaacttcgacccggaaaaaaccaatttggacacgatcactcaagccgtgaagaatatcggctatgacgtcttgaaggccagcgctaaataagagaaaaaagcaaaaataagaaaaacgactaatcaagaaaaaaggagaaaaatgatgatcaaggaattttttaccaagaacgatgaaatgttagacttatatacgcaggcaattaccaaggcccacggcgcccaccacccggaagtctttgaagtccgcaaggtttatgaagacatccaaaagaaggtgagagccggccaggaagacttgactgccgacttcagcaagctgcggtccttgaccgcggattacaccattccggctgacgcctgcggggcgatgactaagacctaccagaccctggaagaattcgaccacttggtccagggctaatttttaccagcagaggagagcaaaatgcagcatatatgtgtcagcctggttcccttattcgtggacctgccagaaaaagaccagcttaagatcaattccctggccagccaccggcgctatcaaaaaggtgagacgatttttcagccaggggatgaaaagctgcagatcgtggcccggggaaacatgaaggtttaccagctgtccgccagcggccgcgagcagctgctccgggttgcccagccgggtgactatgaaggggaagcgcagctttttggcctggaaaacgacagcttcttcggccaagctatggagaatacggaaatctgcagcttgagcaaggccgactttaaccgggtcctcatggaaaatccccagctctccctcaaactgctggaactcagcactcagaagctgctggccaccgaaagacagacccagttcctggccatggagcgggtcgaagaaaggctggccagctacctgctcgacttggctaaggtggctggaagcgaccagttccagctgtccatgaagatgaaagatatcgccctctacttgggaactactcccgaaaccctctcccgcaaattcaaactcctcgaaaaaatgggctatctgaaaaggacaggcaagcaggtgaaaatccttgatgaagatggcctgctggacctgtaatagacaagaaaaatctccctctagattactaggaggagattttttactatcgaaaaagaaagatgaagacggcttagtgcaaggcagttacaaaagtgatcaggccgaagataataaaaggagaactgtttagaattactaggttagtaatttggaggtatgaaaaatgaaaggtattattttagcaggtggctctggtacgcggttatacccaattactcggggaatttccaagcagctgattccaatttacgataagccgatgatttactacccgttgtctacgttaatgttggccggcattcgggaagtactggtaatttcaacgccggaattcatgccgctgttccaaaaccttttaggagatggctcagaattggggatgagcttctcttacaaggttcaagagaagccaaatggactggcagaagcctttatcttgggagaagattttattggtgacgatagtgtttgcctaatcttaggagataatatttactacggggctggtttgtctgagttagttcagtcggcggcacaaaaggaagatggggcaacggtctttggttaccacgtcaatgatccagagcgctttggggtggttgagtttgatgaagatatgcacgccctttcgattgaagaaaaaccagctcaaccgaagagcaactatgcggtaactgggttgtacttctacgataacgatgtggttcaaattgctaagaacattcagccatccaagcgaggagaactggagattaccgacgtcaacacggaatatcttcgcagtggtaaactggatgtgaagttaatgggtcgtggttacgcctggcttgataccgggacgcacgattcgatgatggaagcatccaactttattgcaacagttgaaaagcggcaaaacctgaaggtggcatgcttggaagaaattgcctaccggatgggctacattgataaagaacaattggttaagttagcacaaccgttgaaaaagaatgattacggtaagtacttattacgtttagcggaggagaagtaaacaatgggtaagttattagttaagacaacgaagttacaagatgttaagttaatcacgccagcagtctttggtgaccaccggggcttctttacggaaacctactctgatcgtgacttcaaggaagcaggaattaactttgattttgttcaagacaatcaatccctttcaacccaagctggggtattacgcggcctacacttccaacggggaaaggctgctcaaacgaaattaattcgggttgtgactggagcggttttagacgtcattgttgaccttcggaaggggtcaccaacgtacaagcaatgggaaggctacatcctttcggcaagtaaccaccgtcagttgttagtaccacgtggttttgcacacggttttgttacgttaactgataatgttaactttgtatacaagtgcgataactactatgatgcggaagccgatggggggatttcctttaagacgccagaattagacatcgactggccaatcgaccttgataaggcaatcacgtcagaaaaggatgctaaccaaccaacgctgacggaatttgagaaggataacccatttgtttatggtgaaatctaaaggagcgcttatgtttaagaatattattgtgaccggtggggccggcttcattggttcaaactttgtccactacgttgtaaataatcacccagaagttcacgtaacggtgttagacaagctaacatatgccggtaaccgggcgaacttagctgggcttccagaagaccgcgttgaattagttgttggtgatatttgtgataaggaactagtcgacaggctagttaaggacgccgatgccgtggttcactacgcagcggaaagccacaatgataactcgctagaaaatccagaaccatttattcaaaccaatatcgtcggaacttcggtcttaattaacgcttgtcggaagtacgatgtgcgtttccaccacatctccaccgatgaagtttatggggacttaccgttacgagaagacctaccaggtcatggtgaaggcaagggcgaaaagtttacaccggaatcgccataccggccaagtagcccttactcatcttctaaggctagctcagacctgttagttcgggcttgggtacgctcctttggcttacgagcaacgatttctaactgctcgaacaactatggcccataccaacacattgaaaagttcattccacgtcaaattaccaatattttaagcggaattcgcccgaagctttatggtttcggaaagaacgttcgcgactggatccacacgaatgatcactcccgcgccgtttggaagatcctgacggaagggaaaattggtgaaacctacctgatcggggctgatggtgaaaagaacaataaagaagttctggaaatgattcttgaattgatggggcaaccaaaggatgcctacgatcaagttaaggatcgcccaggtcatgacctccgttacgctatcgatgcaacgaagttacggacggaacttggatgggaacctgaatttactgactttaagaccggccttaagaatacgatcgactggtacacggaacaccgtgactggtgggaagacgaaaaggcggcggtcgaagccaagtacgctaagaatggtcaataatttatgctacaaggtcgccgaattaataaaattcggcgatttttcgaattaggaggagacaaatgacggaaatcttgattactggggcaaccggtcagctcggctcagaactgcgcaatttacttgatgaacgtaacgttgcctatgatgcctttgattcccatgggttggacattaccgatgaagaaacggtaatgtccaaggttgaggagttgcaaccaaaggtcatttaccactgtgcagcctacacggccgttgataacgccgaagaccagttcaaggcggctaactggcaggtaaatgaaacggggacccaaaatattgctcaagcagcgaagaaagtgggggcactcctcgtttacgtaagcaccgactatgtctttgacgggacaaaccctggtgaatataaggaagacgacccaactaacccaaagaatgaatacgggaaggctaagttagccggagaagagatcgttaagcaaactctggacaattactacatcgttcggacgtcatgggtctttggaaagtacgggcgtaactttgtatacacaatgctccgcctagctaaggatcacgatcgtttaacggtggtcaacgatcaatttggacgtccaacttggacccggactctagctgaatttgtgacttacttggttgacaataagagtccgtatgaaacctaccaactctccaatgacgatagttgctcctggtacgaatttgccaaggaaattctggcagataaggacgttgaagttgctcctgttacgtctaaagaatacccacaaaaggcctaccgtcctcgccactccatcatgagtttggaaaaggctaaggcaacgggttacgagattccaacgtggcaagaagcattgaaggaattcatgagcgatattgaggacggtcaggagaactaagccaatggagataacatctcaaaaactaagagcagcatcggaggcctctagaactgcattgaaaatgcatgatcttgttagttctcctagcttaaggaaaaaattgaataagctaattagaccgtttggggtgttcagtttgtttaatttagagtgaaatagtaaaagaaattctaaattgaacggggttgcgattgcggtaatcgtaaaaaatgaagcaccctatattaaagagtgggtcgagtactataaaattattgggatcactaagatctatttgtatgataatgatagtcaagatgatctaaaggatcgaattaagacagacgttgagtcaggatacattgactatcaccccattcatggtaaagttcgtcagagtgaggtcaagtccaaaatgttggtgtaaattaaattctgcgaatttatcatttcacaagctactttttattctaggcccaaacttcgatggaacgtccataactaaaactactacggctttctttagatcgtttgcgacgaataccatggtcaggtaaatcagtcacattaatatccagtagtccctgatcaatccagttatagatggttttgtaggcaattctaactacatgagccacttgttcaattgaccatttttggatcttgattttttcttcaatcaatagctttaggtcagtcgttaagatggttttacgaccacgatgactaagtttaacttcatggtcagtttgagccttaactgcgtgatactaaccagctaagcgatgaacctcattaaagatagtggttttactaaagcctaaataatcggcaatatattgaagtgagtgcttttcatgatgaagtgtttcgatgacaacgcggtcttcaaatgataaaatagtggtgcccataaaggtccttctttctaatggaatgttgtggtgacaccattaaagacctttatgggtttttctgtccactaattatgttcaacttaaattttacaatctaccttaaacaaatacatttaatgcaataaagtatagcttttataaaattactgtcgttttgtttgtaaacggtttacaaaaagagttacactatagctgtaatattatgaatagggggatattatagatggataaagcaaaagttattattgttggggcatcacatggcggtcatgaatcggcaattgagctgttggataaatacgataacgtcgatgttacgatttatgaaatgggtgatttcgtatcgttcatgtcctgtgggatgcaactttacttagaagaccaagttacagatgttaatgacgtaaggaatttccgaccagaagacatcacttccaaaggcggaaatatttttaataaccatcaagttacagcaattgatgttgaccaaaaacaggtaaccgttaaagatttaaaagaaggtacagaagaacaagttgcttatgataaattgattcttagttcaggagtgacgcctaagaatttgcctgtcccaggtacagaccttgaaaatgtatatttaatgcgaggttacgactgggctacaaagattaaggcagcattaactgatgatagtattaaaaatgttgcggtggttggttcaggatacatcgggattgaagcagctgaagtatttgctaagaaaggtaaacacgtcactttatttgacttcatcgatcgtcccctcggcaattatctcaaccatgaaatgactgaaattatcgataaaacgctgactgacaacggcgtccaagtagaaatgagccagagcattaccgcatttaagggcgacggaaaagttgccagtgtggaaactaagaagggtagttaccctgcggaccttgtaattcaagctgccggggtacaacctaatacagaatggctcaagggcgtagtggacctgacagatcgcggattcatcaatgtggatggctacttgagaaccaacgtgcccgacatatttgcagtcggagatgccatcttaccactatctatcccggctggaaaaccatctccaattgctttagctacaactgcacggcgtgaagctcaatacgttgtaaaccatattttcgagaagaaaccaacccaaatctttaaaggcgtagttggctcatcagcattgcatgtatttgacgaacactttgcttctacgggtgtaaatgaatttactgcagaacgttctaacgttgaaattgttaattcacactatgtcgatcacatccgtccagcatacgttcctgagtcagagggcaatgttcgcgtggatgttgatatcacgtttgaccctcatacccacattgttttaggcggcgcagtcctttcaacatgtgatttaactgctcaaggaaatgttttggcattagcggtagagcatcgtttgacgcttgaagatttagccgaagctgacttcttcttccaacctggttacgaccggcaatggagtttaattaatttggctgcgcaacatgctttaggttatgcacgcttctaaagtaaattaatcggtttatacgtagtatgaagtgtccgagaaggttagattatttatctagctttcttggacactttttactaaaacgtcttttttatagtgactttggtgttttacgttattttgccatattaaaaaaatcgtaaaaaggtaaagataccggaattgttgaataaagtaggaccagcaatgcagcaaatgaaggatctttgatcggtactgtgccctgtcaagtttacacattaaatctgaaacttgaaagcgcagaatagcgggcttaacccgtcattctgcgcttttccactctaaaaatagaaaaacgcaagctctcctacgttatactttaactgatcaaaaccaaagtaaaggagttcttgcgctatgaacagtataaagcaatcgcaatcgaatgacgaggctcaattcttaatccggaccttctttaagcagattggtctaggtaaaattattcatcaaattaactttaaacgacacacgccaatcagcccgttgatgatgattaagtggttaatgacgaccatctttgcccgtaaatcactttaccgtgcgcaatcagacgctaatttcaccacccggacggcccgtaattttctgaatgatggccgaaccaattggcaaaagttaacctgcctcttaacgagccaagtaatcaaggcccttcgcccctttatcgattcccgccgccgactagcactaatcattgatgacagtctctttgcccgtccttatgccaagaaggctgagctactcgctcgagtttacgaccacaataaaggggtatacgtccgtggctaccgggctctcaccctgggctggagtgacgccaacacctttctcccggttaatttcgctttaatgtcgagtggaaaagcggagaatcaattgggaccttgcctgaagaacgatcagcggaccttagctagtcaacgtcgaaaccaagcacgaactaagatgaatgaagccgccgttgatctggtttcccaagcccttcagaatggtgttccagctcaatatgttctctttgatagctggtatagttcacctaaaatgtttgacctgatcaaccagctcggccttgatggggttggaatgctaaagcgttccaagaaggtttactatcgctatcgtaagcgcctgtattccgttaagacgctctaccagcgactccagacagaagggcgtaagtctaaagaaggcgccacttaccagtatagttgtgtcgttgaaagtctatcgggcgttgaattaaagttggtgttcgtaagcaatcgccaccatgccaacaactatttagtcttggcaactacgaagacctctctccgcccaaatgaaatcattcaactatatggccggcgctggcagatcgagacctacttcaaagctgccaagcaatacttacgttttgaccaaactcaggtccagaagtatgacggtctttgcggtcaccttgccatggtcatgatgacatatgacctcctagcgtggcaggaaaggcaagagcgggacgatcgaaccattggcgatctattttacattatgggagaagccatgcctgatttgaacattactgaggtattggtatggttcgtaaaaactttacaagaattcatggaagatgaaccaattatcccaaggaacctcctcgaggggactgttaaccaatttattaagcacctaccacaatccgttgccaaacagtttcaagccgcttgaaactgactaatttagtgagcctaaatttcaaatgggccacgtgattagttgatgttcttattgggtagttttgggaacggtcttgctactctactggacatttatttttgtgtttggtgcgtcatttcttggcaccgcctgtacgtcaaggtactgaccgaagagggctacaagccggtagctacgtccaccgtctccgccacatctaacactaactcgcatccaacggcgccccacgcacacgcttaatgtacttaacagtgtaaaaaatgtgaaaaagaccattccgcctcgggatggtctttttcactattacacagataacgtacctcgcttagtcatacagcctgtcgagaaggttaggtcatacttcttgataacgtgctccccaaccgcaggcctagtggctaagtctggccatagaacaccgctggcgcgctaacctgtgccctatccttagcccacggcctgccaatggttggtccgcacttccaaagataacgtgctccccaaccgcaggcctagtggctaagtctggccatagaacaccgctggcgcgctaacctgtgccctatccttagcccacggcctgcccaatggttgggtcgcactcaatcataaatgcataattattcgtttaaatctagtcaaataggactataataggggtgtatgtttattttttaaaatcgattggaggatattttgatggataacaatggttccagcaagaagattacgaccttcgggctggttacgatgatcatcaccgccatctttggctttgggaatgtgtccaacgcctacttgcagatggggtacggcagtatcatctggtacgctttggccgggatcttgttcttcttcccgtgcggcttaatgatggccgagtacgggtccgcctttaaggaagctaagggggggatttactcctggctggccggttcgattggggaacggtgggcctttgtcgggaccttcgtttggctggcgtcctggatcgtgtggatggtttcgacgtcctcgcggatctggattaccttctcggccctgatctttggaaaggacaccacccagtcttggcgggtgatgggcctctcgtcgacggaaacgatcgggatcttggggatcattttaatcctggcgatcaccttcttatcgtcgcgggggatgaacgcgatcgcccggatcgggtcgctcggtgggatcttcacaattgccgttaacattatcttcatcgtggtgtccttcaccgtcttgtttgccaaccacttccagttggccgaaccgattcatggcctcaagacctttatcacttcgcccaacccgcagttccaaaccccgatcgccattgtttccttcgtggtttacgccatcttcgcttacggggggatggaatcgctggggtcggtaaccgacagcatggataacccgcaaaagacctttccgcgtgggttgatcattgcttcggtctttacgatcggcgcctacgttttgatgatcttcatggtcggctggtcggttaactaccacgataacctggggaccaacgccaccaacctggggaacgttacctacgccattttcaatgatattggggttgaaatggggaccgccctcggctggtcgcacgccgcggccttaggctttggggtaacgatgacccggatcgtggcgatcgctcagacggtcggcttcttaggtgccctgtttatcctaatgtactcgccaattaaggcctttatcctggggtccgacccgaagctttggccagctaagttgaccaagctaaataaggctgggatgcccgctaacgccatgtggctacaggcgatcgtcgtgtgcgtaatcgtcttcttagtggccttcgggggtaatgccgctcagggcttttacacgattttgaccgacatggccaacgtttccacttgcttcccgtacctcttcttggtcggggcgttcccgtttttcaaaaagaagaacctggactacccgttcgtggtctttaagaaccgactgtggactaatattttagtcgtggtggtggaaattatcctgatcgtcgggattctctttaccttcgttcaaccgctgctggaacacgactaccagaccgccttttggacgatcgctggaccgttcttctttgctatcgtggcactggtcttttaccaaatttcagcccgtcgccacaacgttgacccgaatgaataagagcgtggcaaccaaccccgccatgtttgctaactaaatcaattgccgtgccagaccgatcagatgttgattggcctggttttttagttaggtttgaatggactccaacggaaaatacctgggtgttatactggcgtgaaaaatgaggacaggacaaatctgcaaatttacgcaagattacgcggtcttaaccacgggcctagtggttaagtacgggcaaggaacggtgttggcgcaccaaccatttgatctagcctagcccacggcgttggtacgcactttcgttttgcgcaaatctaaatatttgtcgtgccaccaaatctgggggggatgcaaattttagcggtggaggaatttttgtcccatcaaaaaagctgagagaaaatcgagctttctcccagcttgttacagtattgatgaaggttagacggataacgtgctccccaaccacaggcctagtggctaagtacgggcagagaacgatgcttaaccgcatcaacccctgccctagcttagcccaacggcctgttgaggaggttggttcgcacttccatcaaaagctatcgcgaataatcagggtcgttggaatgatgtgggtggttggaacgccaccttctttagtttctaacttctttttcaagagtttcgcggcgtcagtcccaattcgccgggagtcctgacggatgcaagagatcccgggacgcatgacggtcatccagtcaaactcttcgtaggtggcgaccccgtaatcggtcgggtaggtgtagttgttgtgttgcatggtttgcagtagttggacaaagacgctagcgttcatcgtaaagaaacccactttcttattcccgcgctgctccatgatccgtttgatttgggtttggaaagttactagcgattctgattgaccagggtaagggaccggaattagatgggtaccgtcagggtaacgtgtggcacgtaaaaagccctggtaccgtttgatacgggtactgaccttttctagtggccaagagacaaagtagagttcgtcgtagcctgcaattatcatccgcttggtcatttcttcaactgcctccgtattattggtggcgacggaatcaaaggttagagtctccatctggcggtcgaacatcacgatgtcgttattggagagagtctggtaaattggattgtcgggattaactggatcaatgatgataccagccacgttttgagcttggagccgtaggatattgctagtttcggtatcctgatcattatcagcattggtgaagatcatccggtaacccgcttgattaaaaaccgccgagattccagaaaggacggtggcggagaagggattggtgatgtcagcaattgaaaccccaattgttttattgtcgttttttgcgagatcgcgggcgacgctattggggtggtagttatgttcagtgataattttagccacgtgggcacgagttttggcagacatcttgccgtaattgtggtttagaaagttggagacggtggccgttgaaacccccgctagtttggcaatgtcgttaattgttagtttttccacgatgctgccccctcgagtgcataaaatttagagagttgaattaaatatgtgcagtttttttcccagtggagagtgtaacatctgttaatgttagtgcggtaactaaagtaggcatatttctctgcgttaatttcaactttgtctcctccatttttttgaaatacactttattaaaacagtcatatgtgtcgtaaatatggagaagccagcatatataaaaaagagtgccatgtgacactctttttgagctatttaatatcaacaacaccgacaaattcaacatcatcaattgcagttaagtaaaaactatcagttggtccaagtattgcaagttgaccatttttgattgtacattcttgatctggtgtggtcagtttcaccgtcccttttaagggaatgagaactatatttccaggtacagggtgaaattctccgttgtttgtcactgtatttttctttagtatacgatgaccaacccgtctttgaccattttcgtaaaggtgttcatggatctcatcaccgcgactaccagttaatattttcatataatatatacccccaagttaattgacttttttacgtggcttttcagtattattggaattttgttgagtgttgtttccacagccgcccatactaccagagccaccgtgcatacccttgtgcataaatagcatcatgagtgggtgtgctagaagaaaaagggctatcagaatccattgtgacatagtttcacttccttttgctttgtttctataataagtttttgtcatcacttaattacacgtttttaatcttttcaccagtcaatcccatcgcattaattgccacgataattgtcgacatcgccatgaccgcagcaccaacggctgggtctagaatgattccaataaatgacaacacaccggcagcgagtggaattgcgacaatattgtagcctgctccccaccagagattttgaaccattttccgatttgtgattttagccaaatcaagaaaatgtaaaatatcgctgggttctgatttaaccaacacaacatcagcggaatcaatggcaacatcggttccggcgccaattgcaattccaatatcggccgcggcaagacttggtgcgtcatttacgccgtcaccaaccatgatgacgtgattgccctttgcttgataatcagtaataatcttttgcttatcatctggtaataggcctgcatgaaattcagtcaatcctagtaagttagcaacgtgttccgcggcttttggattatcgccagtgagcattacgggggtaattcctcgcctctgaagaccactaattaattccttagcacccgctttgatggtgtcgccttcagcaaccattccttgaacttgggtgccctgcaataggaagctgacggaattacccttagcagcccatttatcagcagcggcctcgtcaaacctaatcccttgcttcgttaaatagttaccattaacaatcatatagtcagtgccatcaacattaccggaaataccaacgcccggaatattttgagacttttcagccgcaacgacttcaatgtccttcgcttgggcttcagcaatgattgcttgggccagcggatgagtcgaattattttcaagggcggccagtcggcttaataacgttgtttcgtcaatcccatcatttggaatcaatgcattcaccgtaaatttaccttctgttaacgtgccagttttatccaagagaacgtggctaacatgttgacttgcttcaatggcttggcgatttcgaactaatagcccattttgagcgccaatcgtagtagaacgagaaaccactaatggaatcgctaatcctaacgcatgcgggcaagcaatcacgaagacggtcaccatgatcgtcattgcagtctctaatccctggggtaaccaggcaaagaaagcaataatcccaacaccaagtgccgcgtaaaatagatacttggcaactaaatcagctttatcttctgctttagatttagtttgctgggcattttgaaccattttcattacttgagaaagatagccggagtcaccagtaccactaattttaaccgttagcgtcccgttattgttggttgcaccaccaatgaccttatcgccaacgttcttggtaacggcagcagattcaccggttaccagtgcttcattcacggtcgactccccagccgtaataacaccatcggctggaatactctcacctgaacgcacttggacaacttgaccaacttttaaatcagatactggcacttcttttgtttcaccattatctgtaactagatgggccgtcttaggcaacagggccgccatcttttgtaaggcatccccagcccccatcaatgcattcatttcaatccagtgtcctagaagcataattaaaatcagggttgcaagttcgaacgaaaaatccattacatgatttgccgggttcaagaagttgttggcaataaatgcgtacaaactgtagaaatacgaaacggaaattccaagggttactagcgtcatcatttcaggagatttattctgaatttccgctttagccccctttaaaaatggcattccgccataaaagtaaagtgctgtatcaaacaaaacgatgataatgccaacaattagcggtgaactgaaactaaggatggaaacgtttaaacccatgattggtgctaacagtaaaactggaatcgctaagacaacggagacccaaaatttaactttcaaattccccatatgcatcattgagccaccgtgcatcatcatgtcagtcccagccatatccatatcaccgtgattcatgttcatttggctgtgatccatttcagccatatcgtggtccatgttcatttgattatgatccgtttcggtcatatcgtgatccatatgactcatatttgattcattattttccatattcttagcactcatgtttttcatgttcatatggtcctctttatttgccatgattatcgaccccctaaaaataagtgtacgtagcaaagcggttagaagccggaatataagttccttgtgtggaaatccccgggctcgggatttttccaccaggttcttatatttaggcttctgctttgcggagcaccatgccactatatgaatgagaattacgacaaaaattcataagtttccgccatcagaaatcccagattctggatttttgtgcagcaatcctaaaagtaaacagaacaccacagtcttaacacgtttgatcacctggcaagcagttacactgaacttcctcgggcgctgttttggccttttcagctagaatcgcctgtaagttcgcaatatccgcccgtgagagttcccttgactgaataacgccggcaattgttgaaccagcccgcatcgcacacatatggtcaaacaaatcatctgccgctgccgccattgattccttctcgccaacaaccggcttatacgtgaatggtcgactgccgccatgctgcgtaaccgcctgtttttgaatcaacctgtgaagtagcgttttggttgttgaagctgaccagccttctaattcgttcatagcatcgattagttcacgactagtcgcatgtcccattgtccaaattgctctcataaccatccattcagaatcggtgatggttacattctttggatccttcaattggcttcctccattaattgaattataagtttacatttgtagtctcttaacacttattagtttacaactgtagtcacaataatgcaacctttctgccagaaaataccatgacactaaaaaaacgcctagataatatattctaggcgtggtttgatacgatatattaaattaatgatctgggaatttttggttttcttgttagtatggtgaaatgaaagattatcacgtgcccttatattaccatgtctttataggaaagctcacactaacttcaccaaccgtcaatagtgatatcactagtgttagcgtagttatcaaatatatgttcccgatgacataacaaaggcgctgtatcgacagtgaaaaagccggcatagcgccttttgttatattcaaactctggtctcctctataggatttctcattttcatattcatacctgtctaacagtacgaactaccaagagaacatattatctatacttcataaaacggccactagggtataccctagtggtcatttttggtcctgtgctatactaggaattataaatgttcattagaactgtccaaaaggaagtgctgacaatggctaaaatcggttatgctcgcgtgagttccaaggaacaacatttagatagcagctagctgttttaaagggcgttgataacgctattcacagataaattgagtggggccaacaccaatcgaccagaactgcaaaaaatgctcgcctatgttcgcgagggtgatattgtcctggtcactgaattagatcgcttaggccgaaacaaccaggacttaactaagatcatgaacaccattcaaaataagggggccaccctagatgtgttaaacttgccgtccatgacagggattgcggatcctaatttacgccagctcatgacgaatctcattattgaactgtataaatatcaagctgaaagcgaacgtaagcggatcattgaacggcagcaacaagggattgccctcgctaaacagcagggtaaatatcatggtcggaaacctcaatatgccgaagatgatccccgtttactacatgcttttaaactttaccagacgggcatgagtgatgtagatgttgcccgtaataccgggattaaacggacaacctttatcagataccgaaagaaattcgatgtgcattgaaccggtttacatgagataatcagaatagattagaagccctgaaacaggcgtaaaataacaaatgcttaaaaatgatgctactggcagttggtcgcattgattactcacgtcatgaatgcgaagaacgtgcggacaaccgtacatgccaagaaacataaccgacgagagcaacaagaaacctacatccaagaaaatgtgctgaaccgtcaatttccggttgtctaattaactgactaaaaatagtccaattcattgacttctgagcatttagatgtggtattagatattcataaatttaatatattttcaagtaaaattaagacagtagctaatttatcatttgcatcttaccatcaattatctgataaactttgtctgccgtattttttaaccttaagtcatgagtaactacaataataattttatttctcttatgtgctaaatctctgagtaactcgattactttcatagatctatccgtatctaaggcggctgtgggttcatccgctaagatatagtcaggatcagtgtataatgctctagcaattgccacacgttgcttttgtccaccagaaagttgattaggatatttttttaggagttctaaaagtcctaaatcagatagaagttcatgcattttttgttcagttaaattttgtttttttagtttatctactaatttaaattgttcttcgaccgttaaaaatggaactaagttataagattgtaaaacaaatcctattttttccaatcttaattttgtttgctgttttttggataaacttttaattgtgctgtcatttatttttacgtcaccctcagttggtgtctgcagcccaccggctatagtcaaaaatgtagtttttcctgatcctgatggccctacaactaaaacaagctgaccactttctgctttaaaattaatattttccagcgctacgtacttactactcccttctccaaaaacttttgtcaccgattcaagaattagatttgacatgaaattaacctccaataattttgtaaggatcaactttggcgatttgacgaataggtatcagtgcacctaacaaggacataataataataccgattccagttacaataatattacttttatcgatgacaatgggtacctcgctgggtaacgtaatagctgttatttcacctaatataatggctataataacgccaataactgaaataataaatgattgaaataacgtactcaaaataagatattgcgttgagactccttgcgccttcaagacacctaagttgggtaatttttgaacagtcagaatatacaagaaaattgaaataacaattagaataataatatacaaaaaagcaatcatgaagttgaatgtgagttgttgtgcgctatatccaggtaattttttaataaatgagctaatgctcaattgattggtcccttttggtatttttgaattctttaacttattcttgaataccacagcatttgttacacctttattcagtggttgaatagtgtctggtgaaatataaaccacgggaagagcacttaaagttgccctgggtgtaaaacctgtaattttaatcctcaatgatgaattagcaactaacaagtggtcaccgattttgaatccatcacttttgaatttatccgatacgacgccggcattgtttcggatatttttactaccacttgttattttcaattttttaaatatgaacgatttggaatcaagacctactaattgagtattctcttttaatccattttctgattttacaagtgtactatattgtgaaattctggttccattattgggtaaactagcaacctcatcctgtgaaagaaaagattgttgtaaacgtccttcagaatcactatttaagacaatacttgaagcatcccactcgttaattgccgctttgtttaggttagctaaaccagtggctaaaccagtaagaataatcaaaagataacttactaaaaatataagtgccactattaggctataacgcaatttttcatgtagcatctctttaatagctaaaaacataataatctccttttattaattctatttattattaatatatcacttaatgtgttttgaaaaggtttttactagtaatagtaatttttcttggggtgtcacatatactctttttgataaatcaacgaagttatttctcattaattttgttaggatctttttgtagacattaatggatagttctaatgctactttgccttttctatctaaaatctgattagtaatcacatcagtttcggcgtacttggaaagtgctaatcttgctaaatattgcaacaaagattgtgtttgaatatcaggtttactctctaacaaaacttgtttttggatatcatattttaatagcagttgctttggaatgaaatatctatccgccatagcatcttcatgtacatctcttaaaatattagttaactgaagagctattcccacgtttattactgccttacgattgttttcaatagagtttctagaaagtatacaaaaaaccatgcatcctacagttcctgctacttgataatagtaattttctaattctgatagtgtgttaatttcaacatgattgagatcatgaagttatccttcaatcatatcagtcattaggttgggatctatagagaaatgattaaaaacgtgggctactttatctggaactaatacccgttaaatattgtgtcacaatagaaattcgtaactctaaattaaatttagccataataaaacccccgagattattgtccaatctcgggggttcacttcagaacgccggtggcttttggtgatttcaaattaagcaaaaatggtagcaacagaaccgattacaattagcaagattcccagcagggtgaacctcatttcgtggctagacttgtgttcgtgaagaactaagatcccaccaaaggttgcaatcaccacgttcaactgcgtgaaaataaaggcaacgttaacccctaaactccgggcggcaaagatgtaggcaaaggccgcgatcccccaagagatcccacctaagatattggtgtattgctccttttgtccaaaggccttggcgttaccggtaaagagctcgtacaggattgccccgaccaagatccccaacacttccggtaagaagatcccctctgagctttggttagccaagtatggaattttcgggaaggaagagtaaatccagtaaccgatcgtcgttgctaataagaagatgacgttgctggtggttaccttactatcacccttcttatcagaaaccgaagtcatcaaggccccgatgatcacgattaacagggccccaaaaccgatcaggagggccttagcacccctccattcaccaaagatcatcaccccgatcagggagttcccgaccagttggaacacggttgacagcggaatcgtagaggaaacccccatccgcttaaaggacacgaactgaccaatttgggccgttgaccacagggccccacagaccatcgaaaagataaaggcgcccgccgatacggttggttgggtaatcaaaaaggcgatgatccccacgattgaagctccggctccaatcccgaaaatttggttggcttcggagccacccattttcccggtaatcagcggcatcaacccccacccgagggcagggataagtgcgattaagtattccatctctattctctctctcctaacaatctagaattctcaaatctcaacctaaatattctataacatagtaaccggtttcacaatcttttcaaaaacacaagttcccggtctaggagagtccgtaaatggttttacgctaaccacagcgctttaaaaaaaattggtctacttaccattttcagtaaatttagtctaataaactggtttatgcatcgtcgtagtgatcgtgtttactcccgttgtggggggcgtactcccgatccgggaagaagacggtaaaggtcgtcccctgcccgtaagtcgaatcaacgtcaattttgccaccgtgcaattccactaattggcgaacgattgccatccccaagccagactccccgtactgggaattcattcgtgagcggtcagccttgtagaaacgctcccaaatgttttgcacctgctcttcggtcatcccaatcccggtgtctgccaccttaacctcggtcccttgggccacccgctgggcactaattgtaatctggccgccggtggtaaactgaatcgcgttttggatgatgttaaacatgatttggacaaagcgatcgtaatcggcataaaccggaatgctatcgggcactactagctttagctcatccttgttggcagccgctttcttgcgcagttgatcccttagattttccagcacggcagcggcatcaaagaccttgcgttccatgctgatctggttagtccggatcttctcgtaatttaggttatcgttcactagccggatcaagcgcttggtgtcattttgcatcaactgaatgctgtgcatcttatcttcttcagggatcgcatcgtaagctagcccctccaaaagcccattgatcgtggtcaacggggtgcgcatctcgtgggctacgtcggccatgaactgcttacgccgttcttcttggcgacggatttcctctcgtgacgcacgtagggagccgaccatctggttaaagttggcgcttagttcgtccagttcatccttattcttgttatccaagtgaacctgataattaccctgggccaccaaatgggtcgcggtgttgagcttatcaattcgcttggttaacgagcgggcgatcatataagaaatcactagggccactagcaaggccagcaaaaaggcgaagacaaagttcttcagcagttgcttaacgttttggcgaatcgtggaaacaaaggtcccaatggtcacgatcgccactagcttttgcttgtagaagtaggggtgaataattaaggtcatttcagaggacgtcttatatgactccttgccctccacgttaacccgacgaaaggccgggtaatcagccttcttcttgacgatatcaccgtttttgaggtgtttccaatcactagcggttaactttggcgtaaagccattgctagcatatagttcctttttggccgcgttatagatggcaaagtgcacatcctggcgcgacaaaagacgggcgttgctagagagtgccgagttttcaaagcccgcaaagtcgttagtcttggggttgtagcgaatcgaatcccaaaccaagctatccgaatacttagtgagttgtcgccacgtcgattggtaaatggtttggtccgtgaccgaaataaacgacaccgtgaggatcgccattaatgacaagatgacggccacaaagccgagcatctgccggtacattaaccgcattatttatcatccgcctcgctgtcgtcaaatttgtagccgaccccccaaacggtttgaatcacctttggccccaccttttcaattttttggcggagctttttaatgtgggcgtcgacggttcgctcatcaccgtaaaattcgtaatcccaaaccaactgtaagagctgctcccgggtaaagacctgctttggcttagaggccagggtctttaacaggtcaaattccttcggggttaagttggaaattaagttgccgtttaaataagcctcgcgggtcttggagttgagcttgaagtggctagtttgaatgtcgaattcggaggtcacttgttcggctttgttggcgattcccgacaattggacccgccggcgcaaggccttgatccgggcgattaaggtcagcgggctaaagggcttggttacgtagtcatccgcccccatttcgagccccagcacttgatcactttccgagtcccgagccgtcaagatgacgatcggtaccgtcggcgaaatccggcgaatgtcggcggccacttgcatcccgtcttttttcgggaggtttaaatctaggagcaccatttcccagtcgtcggcttcggccgcaaacttttccacggcttcctcaccatcgtaagcaaaagtggcgtcccacttctcctttttaaaaaacatcgacatcatttcacataccgagcggttatcttcaatcatcaggattttcattatcattccgtccttcgcatttattttcattcggatatctgtgctacctattatagccgacattggcggtgatgtttgttttattcatagcaaatatttaacatagtctgcttggcttgaaaattcccaattaggtttttgaataatgcttccatactcaccagaaaaatcagatatcaagacaagattaagcattaaggtttcaaaaagcgtttttccttgagcataaacggtatctaaaccatatagccaaccagctgatgctgaatacttttcaacgcctttaattttcgtcttatcagtagttcccgtgaaattctgatagctaatcaaccacctgacaaactccgcagttccaattttgtttttttgtgaactagattttggcgaaaaaatatccggtgaattattactttccgaaattaatcgattcatctgtttaattgcaacagtacctttccccgatgcaatttttttactggtaagatcatcataaatctcagccgttacttgataaaatggctgcttgccaaacacatcaaaacgtgctgcatacttttccaaatactttacaacgatatctgaaaaactacctcgttgaaaaagatcttcccacgttgccaataaatcttcttggatgtcatcagtatcatcatctaatgaattatcaatcgggcgccagcttttcgaatcgagttccagccattcatacggattgccattcgcatcaaaccttgtataaaccgttgttaggattgctaatagaaaacgtaaaattgccaaatcctgcgaccgcatctctcctgccaaccgacgataatttttcgcattttgaaagagatcccctaaagaaatctgtttttcttcatcagaatcaagtccaattacctttatccaaggactggtcagcagattaaaactttcttcagccatgcttctcctccaatctttcatagcataaacccttattagatgaatagcttaacctaaagtcaaaaaaatcagtcgtttgttttgatcctaaaatcaaggccaaagaatcgtgcagccaaatactctgttgccattgtggcagatttttagatgtaatgtcttccaattttttaataatcgtatctaatttccattctggagtaacaacacttggtaagcggataacttgatcagagatagtcttatcatcaacttcgactaattttcttccatctagcaagtaaaattggtgatcaatttctttaagtaaaataacttctaaagtctcttgaatatcacgaactgctgcctgtgctttaatctcgccttgcctatcatctgggagattccaatcaagccatttatgaattgtccctctatgtttaggctcagcaatttgaaatactttcgctttattctcagcaattttttgatctttatcaaattttgctttagcttcttttaggccataaacttcgccgtcagtcgctgtgtcatagacttgctgaaccaatttggaaatatcaccaggtaatgctattttttcttttaaaaaatgatccgttttcattaacaaatacttttcgtaaatgtactcattgctttttccataatcgtcatagtcattaatccctaaaatgtataattgaggggtttgcaaacctttaggacgcttaatattatgacgatgcaatcggccaaccctttgcaaaatcaaatccattggtgcgatatcagtaaacaaaacatcgaaatcgatgtctagcgattgctctaaaacctgtgtaccaatcacaaccagtcttggcggccgagcagcattttttccagtcatgctttgaagcctttcttcaattttttgacgatctggtgccaaaaaagcagagtgcaggacaatcgttaaaacgtcttttggcattaaatcagcaatctcctcggctcttttaaccgtattaacaataattccggctacgccaccatcctttatcttggcatttacgatatcaatcagcttattattttcaacattgattcttttaacttgtacgtatttatatttttgtgacacaaaattcgttacttgttttaggtgtttaccatctaacatgcttagtaatggatatgcctcattgttttcccaaccaggctctgtctcaaattggtcactaccaaatttacctttctcataacttttcaaaagctcatttctttttccctttggtagagtagcagaaagggcaattaccggaacattgtatgcacctaaccattgcagaacttttgctagatacgaagacatataaacatcgtagccgtgaacctcatcgataacgactacttttccgctcaatccaaggtgctttaaaaaaagatgtcgttgtttcaatcccatctgcagcaaattgtcaattgttccaacagtaaactcctcaagaattgattttttgccagtaaaccactcattgacaaccactgctcccgaaccttgtacattttctgcccttggtattgcttggtttctttgattaaacttggctttcccatgcatcaattttattgaaagcttggcatcttgttccttagcttcctttgccaaccaatcttcaactcgatcaaacattgcattagacgtcgcttgagttggcagccccataaacagaccattacagccacatcgactagccagctgttcagctactgttaaagcaatctcagttttaccaattcccattggagcttcaacaatcatcatgccaggatcaagagccttactaatttcctgacacattgccaattgaacctcacgtggatgaaatccccagtgctgaacgtaatattcatcaatatcagagacacgctcggcactccactcatcatttatctgccatgtattgatggcattttgataacgctgttcagtattaacatcagcagcagattcattaatgtcgataagtggaaaaagcggttttgatggatcatcattcaaatactcactagatgccaaccagtcagccattatcaataggccttctaaaagtactgcttgaattttattgacccggggaatttctgatgatttatgaaatccgcataaatgtagaccatattggaatagatcctcttgaacctttctccatcgattctgttcttctcctggcgtctctggccaatagttttctgaattataccgtgtatcttttgccactggattgcttaaaggcttaccatgatgaccacctattatggccgcaatagatttatttactccatatacttctaacaacgcttcaccggccaatgcatgaggtgatgcactacgtttcaaaaatgataatttatcgatgtctttgaacccacctcgaatcattttttccataatgtcttcatcaagcgagtcattatgggcatatgattgcttggtttgaaatgcagttgttgcctttccaatatcatgaatatagccaagaaatttaactacattttgtgttacactttctgaattttcaatcattagcaatgacctttgattatcagttagccaatgattgtacagccaattaataacattttttgcatcaattaaatgtataatactgactttagtcagtggtggttgacaacaatcaacgaccattgtacgtggtttagggcccggattccagccctaatttcttttgatttaaggttttaacgtaaccgctatcatgctataataattaaaagatcaatcgactctgttaaacacctccgctccttgcgggggtgtttactttttttaaccggtcaccaaacgacacacgacaaatatttagatttgcgcaagataacgtgctccccaaccgcagacatagtggctaagtacggtcaaataacaccgcgttccgcgctaacctttaccctagcttagcccaacggcctgcttgataggttgggtcacactcctttttattacgcaaatttgcggatttgtcctgtccccaaaaaggagcctgggagaaaatcggattttctctcaggctctccctattttacctaacggttggtcgcacttacgataacgtgctcccaaccacaggtctagtggctaagtacggacggagaacgatgcgtaccgcatcgccccccatcctagcttagccatacgacctgtcgagtaggttggtccgcacttccttatttcagcaacgccaccaccttatccccggtcgttgggtaggcctcgatcatggccgcttgccactgggcccgtgacagccccaagccaatcgcgggcaggacggcgttgacatcatcggccgcccccgcccccagggcactgatcccgaccaggcggtcctggttgtcgtaaacgcagatgtagtgcgggtgctcgttttgcccggcgtaaaggctactaccgccccaatcaaattcttcaacgtgctggccagccgttgcttcatcggggttgaccccggcctgggctagggtcgggtaagaaaagacggcgctggccaccaccggtaggttgaagggcgccgttgggtcatcgtggccaaagcgggttagcaggtagtcggcttggcgctcagcaaccggggttagcttgggccacggccggttaaccacgtcgcccaccgcgtagacgccggcaaagctggtctggaggttttcgtcgaccgcgatcccgtggcggtcgtattcgatcccggccgccgccaggttcagcgcttcgacgttggggatccgtccggtggcgtcgatgacatagtcggtcgtcagggcgttgccattattagtgattaaagtaaggctcccatcttgtggcttgagttcagcggggctggtgttgaaggcaaagcggatcccccgccccgtcatttccttgactagccgccgcacgtttccctgggcgaagtttttcagcacccggtcgccgcgaatcagtagggtcacctgacttccagccgccgctaatagggtggctagctccatggccacgtaaccgccaccgatgatcgtcgtggtggccggcaactggtccagggacaagacgtcggtggaatcgtgggttagctcgctgcccgggaaatccagccggtgcggacgggccccggtggcgatcacgatctggtcgccggcgaattcctcgtcccccacggcaaccgtgtgcggcccggtaaactggccggcgcccaccttaacggtcacccccggcaactgttcgtagatcgccttggtttcgctgggccaagagtcaaagcgggccttcttggtcttcatcaaggtagcccaatcgacggtggccgcctgatcaatccccttacccactagattggtggtggccaaggcggcgcgaacggccccctccaaaaagatcttgggctcgcaccccacattggggcaggtcccgccaaacaagttgggttcgaccgccagaattcggtggttatcgccagccaagcccttagctagcttgtagccggccggaccagttccgagcaaaatgtagccataaagttccatttaagccacccccattaaattcttgattgcgccttcattataaacctaaaaaggggagcgtggcgcctggctacactccccttttacaacatgctcccaactgcaggtctagcttagccatacggcctgcttttcggttggtcgcactcctttttacaagtacttcttcagcgtgtcttcaatctggtccttggtgtgcaaaccgatcagcttgtcgacaacttggccgtcctttttgatcagcagggtcgggatgctcatcacgccaaaggcggccgccgtttgtgggttagcgtcgacgtcgagcttgttgacggtcacttggccggccatgtcatcggcgacggtttccacgattggggattgcatccggcacgggccacaccaggttgcccagaagtcggttaaaacgaccccggagttcgtgtcttgttcaaaagttgcgtcagtggtttctgctactgccatgttaaaggcctccttgataaattcttaagctaagtttaccagaatttcaaagcggtaccaaatattatgacttactatttgttagtttatttttaaccgtcggcacccctataatagtaacattaatgctacgaaaggtgttttcccatgtgcttatcccaactcgccagccaaattgccgtgatttttttgttgatgctactgggggccctcgcccgccagctgggttttctaagcccgaccacgatcaacgacctcactaatttggtcctctactttttaagcccgctcgtgatcatcaaggccttcttggcgcccttttccgtcacccggctgaagatcttttgcctgaccctggtcggggtggtgatcacctacctggtcacgatcctactggccaaactggcctttgctaaggttaaagacgctaacctgcggcggatcgccacgtacgggtcgatctattcaaacaacggcttcatgggaatcccgctggcccaggccctctttggcagcaccggggtcttttacggggtcgtttcgatggtcggtttcaacgccttcacttggacccacggggtggcaatgtttaaaaaacagtctgccgccccgctaacccggctcaagcgggtcctggccaaccccaacttaattgccatcgccttggggatcgtgatcttcaccgttcaaattccggtccccagcatgctgacgtcctttcttgactacgccagcgccgccttcaccccgctatcgatgatcatcatcggctccaacttagccggtatgcgccgtgccgacctgaaagtcccaccagttttaggggcgacgatcttgttgcgtaacctggtcttcctggccctgacgatcgtgatcgtcaaccaccactgacttcgtggccgggtggttcacttaatcttgcaatttaggacttatcttttttaagcgttaccttcatgatcgaatccccaagtttaacactccgctgatcaacgggggccaggggttctaattcctgtggttcggtgtagaaaacgaccacagaatcttcataaccttggtctttaattaaatcccggttaaagtccattaataattgaccggtgtggactcgttcaccctcgctgcagtgggtaacgaagccttcaccccgcatgttaaccgtaccaaccccaatgtgaatgattgtctttaacccctgatcagaaaccagaccgattaagtgcttggttgagaagagaaagacgaccgtcccatcgaaaggtgcgtagacgtgaccactcgctggttgaatggcaaagccaaggcccttaaaggggtgcccctcgacctgaacttgatctaaagatatcagattcccatcaaccggcgccagtaccgttgtcgttcccgttgttgctggttcggcttcaaccggggtaaagtccgattcaccctccgccaacttagaggttagttcgtccacaatctcggcgtgggccttttcggatagcttaaccttccacaggaaaatcacaactgacaagacagccagggccagtggaatgtaaaaggctaagctgttaaaggtggcgatcttcttggccgtcatgtcggcagctgtggcggcgcccgtcatcccagcggcaatcacaatgtagccgaccagtccgttggagaaggccccggtcaggttatcaattaagggccgaatggacaagatcaccgcttcgttccgctccccgttctttaactggccgtattcaattgcgtcagtcatggttaaaatagccaccagctgggcaaaggtgaagtagtaaaggaccaggccgatgattaagagggtcatgttatcgtgggcaaagataaagatcaaataagccaccatcatgcagaccatcccgaccgtgtacagaaccttgcgggggatgaacttgttaaggacggggtaaaggggcgaggtcaaaaaagaaatgatcattgcggccatccccactacccagtaagtacccggccggttcaggacaaacttaaagaagtagtagagaaccccggtggtgatggtgttggccagtgagtacataaagtaagccaagcaggtccaaagcagttgatcattgtgggccagggcccgggcaacgtccttaatggtcgtctttcggttggctgaagaccgaatcaagtcgtccttttccgtggtccccgtgatgacgaagatcgcacagataattgccaacaggccgatgatggtggcgaaggcgaaccagcccggtcccccctgggtgtgcttaccggtagtgaggaaggtgaagtaggtcacgaccggcaccacgatgatcgtcagtccgttccagccgatggagccggcgaaggtccccatcgaggtgtagaccgaccgttcatggctgtcttcacttaaggctggtaccatcccccagtaggagacgtcagcaaaggcgtaaaagacgtccatgatgatgaagatcagggcaaagacaatcgcgtacaggagccagttaaccttgattaagccaaagaaacccgtaaagagggtcacgaacaggaccgatgaaatcagggtcccggctaagagccagggtttaaactttccccagcggctcttggtgttatcaaccacgttccccagcagggggttaacgaaaatttcggcaatccgaatgatcacgattaggctggtgatcatcccgattaagcgatcggcaatttggctggagacccccgtgaacatcactgatgtcacgaagacaataaagtaatttgatagggccccgtaaaaggcggcgtggcccaagtttcccattccaaaggcaaacttggggtaccaattatttttcggttttgcgttcaatgttatccacctcttcgttagatttgtaaccggttacatttatcataacaaattaggatggcataacccgcgctgaggccagaaatattcttgctaaattaatttacctgcttgggaaaggacttgcgaaagaccagttctaggtcgacaaactgatggatatgggaccggtgcgggtggttaatggcatcctgcagggtttgaatcgttaagcggaccaccgtcgcctggtcgatccggtaagtggtcaacggtggcgacaggtaggaagcgatgtcggagtcgttgattgaaattaagaccgtgtcggcggggacgttaacccgggcctcattaaaggcttggaggagacccacactgagggtgtcagaagcaacaatgaaggcaatcggcaacttttcttcctgcaaaaccgcctgacctagctgatggccagtttgaatcgtgaagttttcgcccacgtagctcagcttctccaggtgatcccggttaaccagcagctcgtattctaactggcgcgggtccggctgacccttcgacccgattgccccgacgaaggcgattcggtaatagccccgctcccgtaaacgctgataggcgtcatcgattgctaagcggaggttgggctggacggaatcaaaggattgcggggccgggttgacgtcaatgaagacgccggccggaatcttttggtgtagcttttccagttgggcatccgttgatttttcgtagccgaccgcgatgaagccctggtaagtcgaccggtccgctaacagatcggtaaggttgtggaaggttgaaacgtggaagtcggactcgtctaaggccttcccaatcaggtccaccagttgctcatagtagcggtcgtggaggtgctcggtggggttaatcaggatcaggagggcaatcttagcggagatccggacgttggggttattcttccagtagcccatttcatttgcgacctggaggatcttatccttggcctcggtcgaaatcgataaacttgtgtcatccgatagcaggcgggaaaccgttgactgggaatacccggctgccttggcaatgtctttaatggcgaccatttcgccacctcctctgacatatttccattcatcttagcataggttacaggccgatttagtaaactgacgggaaaataaatttagtaaataattgtagagtgtgaaataaaagggctgagggaatcccccagccctttttaattctggcagattgtaaaatttaagttgaacatttaagtggggcgaatttacaattgaaatgcaacacaaagtaaaaaaataaaccttgtactttgaaaactaaataatatcaatttctaataaaatcaagaaaaccgagaacaccgcgttatttgagtttttaacgaattataatcgcatactcaactaacttgactgatctacgatcagtaaggttaagttatgaagggcgcatggtgaatgccttggtactaggagccgatgaaggacgggactaacaccgatatgcttcggggagcggtaagtacgctttgatccggagatttccgaatggggaaacccaatcatcttagtcgatgattacttgagcagtgaattcatagctgccaagaggtagacgcagtgaactgaaacatcttagtagctgcaggaagagaaagaaaattcgattccctgagtagcggcgagcgaaacgggaagagcccaaaccactgagcttgctcagtggggttgtaggactgaactttggagttaccaaagaatcaggtagtcgaagtggctgggaagccacaccagagatggtgatagtccagtagacgaaacctggttctctccgttcaggatcctgagtacggcgggacacgtgaaaccccgtcggaatccgcgaggaccatctcgcaaggctaaatactccctagtgaccgatagtgaaccagtaccgtgagggaaaggtgaaaagcaccccgggaggggagtgaaatagttcctgaaaccatgtgcctacaagctgtcggagcccgttaatgggtgacggcgtgcctcttgcagaatgaaccggcgagtcatgattacgtgcaaggttaaggtggaaaaaccggagccgcagcgaaagcgagtctgaaatgggcgtacgaagtacgtagttatgtacccgaaaccaggtgacctacccatgtccagggtgaaggtgcggtaaaacgcactggaggcccgaacccgtgtctgttgaaaaaggctgggatgaggtgtgggtagcggtgaaattccaaacgaacttggagatagctggttctctccgaaatctctttagggggagcctcggaatcgagaatcttggaggtagagcactgtttggacgaggggcccgtcatgggttaccgacttcagataaactccgaatgccaatgatttatgtccgggagtcagacgatgagtgataagatccaccgtcgaaaggggaacagcccagatcaccagttaaggtccctaaatatatgctaagtggaaaaggatgtggagttgcatagacaactaggatgttggctcagaagcagccatcatttaaagagtgcgtaatagctcactagtcgagtgattctgcgccgaaaatgtaccggggctaagcatattaccgaaactgtggatgtgtccttttggacacgtgataggagagcgttctaagggcgacgaagttagaccgtgaggactagtggagcgcttagaagtgagaatgccggtatgagtagcgaaagacaggtgagaatcctgtccaccgaatgactaaggtttcctggggaaggctcgtcctcccagggtaagtcgggacctaaggcgaggccgagaggcgtagtcgatggataacaggttgagattcctgtaccagttaaatgcgtttgaatgatggagggacgcaggaggctaagcaaaccagacgattggaagtgtctggccaagcagtaagtcaggtttagagtcaaatgctttaagccgggttgacaagctgtgatggggagcgaaattaaagtagcgaagttgccgatgtcacactgccgagaaaagcttctagtgagtatttaactgcccgtaccgcaaaccgacacaggtagtcgaggagagaatcctaaggtgagcgagtgaactctcgttaaggaactcggcaaaatgaccccgtaacttcgggagaaggggtgctggtcgcaagaccagccgcagtgaaaaggcccaggcgactgtttatcaaaaacacaggtttctgcaaaatcgtaagatgaagtataggggctgacgcctgcccggtgctggaaggttaaaaggaagagttagcttcggcgaagccctgaattgaagccccagtaaacggcggccgtaactataacggtcctaaggtagcgaaattccttgtcgggtaagttccgacccgcacgaaaggcgtaacgatctgggcactgtctcaacgagagactcggtgaaattgaattgcctgtgaagatgcaggctacccgcgacaggacggaaagaccccatggagctttactgtagcttgatattgagtgtttgtactacttgtacaggataggtaggagccgtagaaaccgggacgctagtttcggtggaggcattggtgggatactacccttgtattatgaccactctaacccgcaccactgatcgtggtgggagacagtgtcaggtgggcagtttgactggggcggtcgcctcccaaaaggtaacggaggcgcccaaaggttcgctcagaatggttggaaatcattcgcagagtgtaaaggcacaagcgagcttgactgcgagacagacaggtcgagcagggacgaaagtcgggcttagtgatccggtggttccgcatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacataccgctggtgtaccagttgttccgccaggagcatcgctgggtagctatgtatggatgagataaacgctgaaagcatctaagtgtgaaactcgcctcaagatgagatttcccattcctttggaagtaagaccccacagagatgatgtggtagataggatggaagtggaagtgcggtgacgcatggagcggaccattactaatcggtcgaggacttaaccaagtcaggtgtgaggattcttgatagttccttaatgatttaatctcaatggtcaatcgatacaacgacaaaacccctgaaccataatgattcaggggctctattagctaacgtattcaccttcgaccgatcttacatccggcctgccaaatggttgggtcacacttcccaagataacgtgctcccaaccacaggcctagtggctaagtctggccggagaacgatgcgtaccgcatcaacccccgtcctatccttagcccacggcctgtcgagtaggttggatcgcacttccttattaatgactaaccttaatcagccgggcaacgttctccgcggtcagcgccacgtcctgggcggcgtcggcaatcgcttgttctaaggacttggctccagacgggctggcaaaaacggcgtcgatcacgccctcgtcggctagttcggccacgcccttaccgaggtgaccggcgatcccaattaccggcgcttggggggccacccgcttggttgtcttagccacgccgtacggggtcttaccaaacttggtctgaaaatcgatgctcccctcgccggtcaaaacgtaatcggcgccggccgcctgctcctctaactggctgtactcaaccaccagttcaattcctttttgcatggtggcgttggtaaaggccaagagcccagtccccaatccgccagccgcaccggctcccggcttttcctccaggtccctgcccaggtcggctttaatcaccgctgcgtagtggtgcaggttgtcatccaaaagcttgaccatctccggggtcgcccccttttgcgggccaaaaacggccgacgccccttccggcccggtcaaggggttagtgacgtcagaggcgattaacaccttcacttccttgacgcggcggtcgaccccactgacgtcaacgtgggcgacttcccccagggcgccaccgccgaggcccacctgctcgccggcatcattgagaagtttcactcccaaggcctgggccatcccggcacccccatcgttggtggcactgccgccaatcccgatgatgatttgatcgaccccgtggctaacggcatccaaaatcagctccccggtcccgtaagtggtggcgatcagcgggttcttggtttcttcggtcacgtagccaatcccgctggcctcggccatctcaatcaccgctgtgttggaattacccagcaagccatagtgggcttgaaccggttggttaagcgggccgtgaacggtcttgatcaagagctggccgttggtagcgtcgactaaagactgcaccgttccctcacccccatcggccatgggcaccaaggtttgctcggcgtcgggataaacccgtttaatgccggtcgccatggcggtggccgcttccttagccgttaaactgcccttaaacgaatcaggcgcaatcacaaacttcattttacttcccccttaaatcaggtgtaagaaaccgtagagaatcgtggcggtcagcattgccgagcccccaaccatggcttcatataggatcccttgcgaccgttgcctcaggtccatgtgcatggcgttggccgtcacgtggaagtagttcccctgtggcagctggtcgatcacgatcgccccggtgtggaccatggcggcggcggccagtggcgcgaccccaaagcctaagatcgccttagcaaaggagccggtcgctaggatgaccccggtcgaagtcgaggcggtggcggccgccattaagatcccggagatcggtgccaacaagaccccgggcatgtggctagcctccactcccttgattaagagttgtggcaggttcgacgaggtaatcgtcgccccgatcgccccggccccaatcaagatcaagaccacgtcggtcatccgcgtcatcccgacccgggcgtaatcgcacaactcccggccctttttcatcaccagggcgccgacaatcgcggcaaacggcagtacgtaggtcgcgtctaagttcaccttagtcaacagcgtcaaatgggcaacttggccgatgggatttaataagagtaagacaattgctaaaatcggggtcaccacggcctgaccaagggtgggtaagttgccggtgtcactatccaccatgtcgcctaaatcggcttccataacggcgtcgccctttttaaccaacaagcgggccacgatcaccgtcacaatcagggccaccaccgccgggataaagtcggcgatcatgacctggcttaactcgagcccaaagcccttggccgccgcaatcgtgttggcgttaggcgaaatgatgttcccggccttaccgccaccggataaggcgaccaagagggctagcttggaaatatgcatccgtcgccccacttccagggcaattggcgccacgatcaaaacggccaccggaatgaagacccccacggcggtaatgaccatcgtcgctagggccagtgacaaaatcgccattcgatcgcccagcttatccacgatcgtgcgggccaaggtttcggcagccccggattccatcattaccccggctagcattccggcggctagcacccgtagcaccgtccccatgacgctttgctcccccttgaccaggatgtcaatggtaccagtcaggctggccccaccgagcaaggccccaataatcgccccaagcatcagggaataaaccggattgagcttctttaaaattaagtagattgcgagcgccaagccaatcagcgctccccaccacgaaataaccatcgtcaacctcctttaggttctgtgtaaccgattacattagcgattatactccaccttggtgtaaaagaaagtcgaaattaggttagtttcaatggtcaattgggaaaactgagtagcgcaaagccgaaagtgagacaggacaaatatttggatttgtgcaataaaaaggagtgcgacccaaccacaggcctagtatctaagtacgggcgaagaacggcgccgagggcgacaaccatttgccctagcttagccatacggcccgtcgagaaggttggatcgcacttccagtttgcgtaaatttgtagatttgtcctgtccccaaaggtagcaagcaacaaaaaaaaagccccataaaggggctcaatagtggcctatccatcccatgactaaagtcacgggattcccggctaatattaattaaaaccgcaagcccttggggaagaagttcttcagggtcccgttgactaacttgccccagcctgcggcgtgttggtcgcactcaaccaggtaccagccgttctttggggcgtcctgaatagtgagggtatcgccgtggacgtaggttcgccaggccggttcgtccacttccaccacctgggtgcaagtggccggcttggtggctaacgccagcgccagggccggttcgaagcggttcttcttgaagacccccagctgcaggcccggccgaatgaggctcatctgatcaatcgctggcatccccaccggcaggtcatagaggtagtcaccaaagacgaccaactggcccgcttcgtaattaggcaacacctttgtttggaagtcttgccacagggcttgttgttccttagtgggggcaaacttactccgttgaccacggccttttttctttttgtttttcttggtggggaggacgggttcttcaccgttcttaacgaacttagcaatgaagtggccctcgcccttgaagtggtggggaaagaggcgcagcgccttagtcaattcggggttaccgtccgcccaccccggccggccggcgtccatgcccggcgccttttctaattcgaccatcgttaggtcgtagttgtttagaagccaagctgccatttgctcatcttcttcgggggcaaaggtacaagtcgaataaaccagggtcccacccggcttgagcattttcagcgccgaggttaaaatgtggcgctgacggttggcacactcggccgggtagtcttcgttccaatactcaatgccggccggctcctttctaaacatcccctcccccgagcacggggcgtcgaccaggatccggtcaaaaaaggccggaaactgcttttccagttggtcggggctttcgttggccaccaccacgtgcttagccccccaccgctccaggttttcggccaggacctgggcccggttcttaaagatttcgttggcgaccaaaaggccctcgtcgttcatcttagcgatcaggtgagttgacttgccccccggggcggcgcacaggtccaagacccgttcgccggactgcgggtcggcaaactcgccgactagcatcgccgaaggttcctgactgtagacccaaccagtgacgtgatcgaggctgtggccgtccactttgcccaggtacccgttggtaacgtaggggctttggcctaccgccgtttcaatcgttgcggttggctgacccggttttaaggggttggcccgaaagccactttgaacggtcccggaagtcagggcagccagaaaggccggggcctcctcttttaacaggcgttggtacttttcaataaaggcagttggtaattgcacgatggtttcctcgttttcttttgacatccgtttcattttacccgtctaactaggggcgcgcaagatttgtcaaggcgccgctcgatcggtataatcaagctattgactttaaaagcgagggataagcatggaccaacacttgatcgccctagacatggacggcaccaccttaaataatcaatctaagctgaccgaccacaccgtcagcaccctgcgccggctagctaacgatggccacctggtggtgatcgtgaccgggcggccctggttgatctcggcgcacctttacgaccagatcggcctcaagtcgccgatcatcaattttaacggcgccctggcccacctgccctaccaaaattggaagcacgagtacgccattaaggtgacccgcgaactaaccctagacatgctagaaagacgccaggaacttggggttcagaccttgattgccgaggacaaacaccacgtctgggcggaccacccgtcaaacgaactgccggaatttttgccggctcaactcagcgacgaccagatcctcaacgaacgcaatttaactgacgacccgatcgccctgacgattcagtttgaccccgccaaaaaagacgcaatcatcaaccgggtcaacgagcgctacggtgactttgtcgaaccccgggtctggggcgggggctattcgatcatggagctgatccaccgcggcacccacaaggaaaccgccctgtcttatttagcccaccacttccaaatcgaccgccaacacatcgtggcctttggcgatgagcaaaacgacctcgaaatgatcgacttcgccggccacggggtcgcaatgagaaacgccattcccgagctcaaggccgtcgctaaggacgtgacgaccctagacaacgagcacgatggggtcgctaattacttggagaagtactttcaactataaaagagggccggcacttgccggtcctcttttacgttaaatggtactgcggattcgttgccactctttttggatgtcttagtcaatttgattacgctgttttctatgctcaatctgattacgaagaacttggaaggaacgtaggggtactattccctgtcaagttgacacttatcaaaatttatgggtaatttgtagtatactatgtcaaaaggaggagttagatgaacaatcaaatcacactagcgtatttagattatgatgatctagatgctttacaagttgtaagtgttgtcagtttttatgaatcgtttatcgatggcgcggatccacttgatatgcaagaatatttacagacacaattgacaactgaaatattggcagtagaattggcacagtcaaccagtaaatttattggtattaaggatcatcaaatactcattggttatatgaaagtcaatgatgaagaagatgctatagagattcaacggatctatctgctcaaagattatcaaaacaaaaggttagggcaacatgtgatgatattcggctcacaagccactgactttagtcagtggtggttgacgttagttgttaactaattaaataaactggttgattgtttcagatttgaccccggtgattgtaagagaatatgggtggtaaagagggcattgtactggttaacccaacgctgtgggtaagtcaggggaaataggccgaaatttacaaacacttactgatattaaaattattttacccgctttcttgggtggtatacaataacagcaagtaagggtcgacccttgctcaactgttacgtaactttagggataattacccttggattttaaattaaggtttacactaagttagaatcgtgctaatctagtggttgtagatgataatcgttctaaccaaggaggacattcagatgaactttttaaaccaagaaattgacgactttaaggtgcaagcataccaagatggtgacaccaaggaagttactaaggcggacgtcctgggtaagtggagtatcttcttcttctacccggccgacttctcctttgtttgtccaacggaactagaagcattacaagataagtacgaagaatttaagcaagcagacgccgaaatttactcggtttccgaggacacggaattcgttcacaaggcctgggcagaagcttccgaggaaatcggtaaggtaaagtacccaatgttggctgacccagccggtaagttagcacgcatgtttgatgtcttggacgaagaagcaggccaagcttaccggggtgtcttcatcgtggatcctgatgggaagatccaatcttacaccattaacaacatggggattggtcgttcggcagaggaaattttacggacgcttcaagcggcccaattcgttcgcgaacacggtgaccgcgtttgcccagctaactggaagccaggcgacgataccattaagccaagccttgacctagtcggcaaactgtaaagggcggtgatcccgatggaccaagagcacatttacgatttaattatcatcggcgccggaccggccgggctttccgccggaatttatgccggacgtgcaacgttagataccctaattttagaagcggacacggttggtggtcaggtcacgaccacgtcaattgtttataactacccagccgcgccggccattgatggcactaagttagccaaccagatgcaaaagcaagccgctgactttggcgtaaccattaaacgtgatggggtgcaggaggttcaactggatggcgagatcaaggtaatcaccaccaagagtgggcaccaataccaagcccgtagcgttgttgtcgctactggggctcacccacgcaaggttggctttaagggcgaagatgaatttcggggccgtggggtagcttactgctccacttgtgacggggagctcttctccggcctgcaggtcttcgttgttggtggtgggtatgccgctgccgaagaagccgactacctgacccgctacgctaagcacgtaacggttctcgtccgtggtgatcacttctcttgtccaccactaacggcttcacgggcactcgataacccgaaggtctccgttgagtataacaccgagatcaaagaggtttcaggagacacctacttaacggcgatgaccttggttaacaatcagactggccaagaacaaacctaccaagttgaagagggcgataagacctttggcgttttcgtctatgttggaacggaaccagaaacggacctctttaaggggcaactagacctcgacagccatggttacatcctggccgatgaacagtgcgccaccaacattgccggggtttacgccgcgggggatgttttggctaaggaattacgccagatcattacggcagcttccgatggtgcgttggcggctacgaacgcggaggcttacgtaacggcggaaaagaagcgcttgggcatccctgttcacgttaccccagctaagccagcggccaagaccgtgggccaaactagccaggtggcggaccagccagcgccccaacacactggtgattggttcacccctgacctcgttgagcaactaaaggtaatctttgggcgcttaactaaggacgtgaccctccaggtgctgggggacgatagcccattaagccaggagttaacctcctttgttgatgagttagcgaagttggattcccacctccaagttgcaaccgcaccggttccggccgaccttgacttggcaccacagcttcgcttgcttgttgatggtctagacaccgggttacactttgctggggttccgaccggtcacgaaattaattccttgattttagggatttacaacgtggcggggccggggcaagagattgcgccagaattggtggaacggatcaaggccctgccggcaaccgaaattgagatcggggtttctttaacctgtcacttctgcccggacgtggtggccgcttgccagcggatggcctcgttaaacccacaagtaacggcaaccatgatcgacctgcaacacttcccgcagcttcgtgaggaacggcagatcatgtccgttcccgccacgatgattgatggtgggccggtgatcttcggtagccaaaccttggaagaattggtccaggcggctgaacaggcgacagttaaaagctaagaaaatcaaaaagtggattggtcttaaccaaaagaccggtccacttttttggtgccagagattgaaaacggctccacaaacggttattattcttattagtgaaaagtatgacaagtaagaaagaggtaattgaagacgaccactttgcaccagaaccagtttgagtgcaacaatatcaaatcaaaagacatggtcagaataatgatcatcttgagtgaggtgcgtaaatggataatgcaatcataaaaaaggatattctccttaatttaagcgttgaggatgggggctttgatttttctacatcgattgctgatgcaatggcgaaagctgaaacagagcttgtcgttttgaatgaaacggtagattcgattaaaggtctgaaaccagactgtgataagttggattatattttggctacaagttctggtaccttgtgtggtatcatcgacatttttttagtgggtaagcctggtgagtcacctttaggtaatattacggataaatggtttgtagccagaacgatagattttgcaaaactgtgcgatccggaaaagaaaaattttgatagccttgattccgcattgagattcttggagaagaaatttaaggttccatatgaccagaccggactgggtgacgctggaaagactattttcgatttgactgccaaaaatcatcatttcaaatctcttgcacacaatccgagtttgttgggactgttcttttcgatactcgaccagttcagcaatacatctcattttgttacagacggtcaacttgtttctttgcaacaggcagatgaaaaatgggaactacgaggcggtaatattccaagtaagctgttctgtggatttgctaactggataggtcatcttatttcggatgtatccggttcatcgtcaagtgcggccaaaggtaatcgcggcacgggccttccatctccattgtggacatggaccaatgacattattgccataaaagctaaattgggacttagtgtaactgaaacggacaaagctatgaatgagctggctctaaacatttttgaaaaaggctatgatattcggttccagacagctcaggctataccagtatttttgaacgagcttcttgttagactcatttatgctattcgccgtctattcagatatttttcagaaattccaaagacagaacgctcctttgcgctcatgtggaagaaatgtgaaccattctcaaatgctacagttaaacgaatgttgacggttgcacatggtacattctgtttggttgatgtcggtgatgcagtgggcagatcgcttatagctggtggaggtacttttaatgcggtagagtttgtcttacgatttaacgttgtcggagtcggacgatttgcaatatctctctatggtgaaacgaggagagcgatttcctataatcacgcaaagaaagaattcgattttgcgtcaaaggaaaccgttattattagcaattacatagagggtctgaaaattctggcacatcagtacgacgaccaccacctgttaatgtttatcagtgacttcgaaaaaagcgatgcttatatagaagcttttggaaaatcagtaacattagcagaagtgcgtaatgttcccgtaaatagaattctgaaaagtaagccggacatagacaagtactttggaggaaaataatatggcaaagaagtcatcaaaacttaaaaaagcgcaacagaaagcaaaagttgctgcacagaaaacgaatcaaaaaataaatgagctgggaaaatataccagttcattgtacaactcattgaccacggtacagtcgttatttgaccgcattcgcaatgtgacggaaaaaaacatgctgaaatatgagaagttaaaaacaatcagagttaactggaaacagcaggctgagaaaatagaactggaatataagaaagcggaggtaaaagctactggtcaaggcgttgctggtgttggtgccggtgttgctgttgctgcgcttggccctacagctgctatgggtattgcgaccacatttggagcggcttctaccggaacagcaatatctgctttgagtggtgcagcatttacaaatacagcgctggcatggttaggtggaggtgctttagctactggtggcggtggaatggctgcgggcagcgcctttttagcacttgcgggacctgttggctggacgattgccggcgtttctattgtagcaagcggtctgatgttttttaagacaaacagcgataaggaaagacttgagaatacatacacgcttattagtaaccgtgacatcaaatcatacgaacttgctattgtcgaactaagtaagcgcattacaagaatcatagatgaatctgagaaattaagagaagccattgtgaagatagaaaccttcggaactgactacaccaagatgacggaggctcaacagtatgagttgggtgcatatgtcaatctaatggaagcatccaccgcgctacttgttaatccaattttggggcttcaacccaaatattcagagcaggattttgataagttgtgtgcatctgaaagcgaattgtacagacgctattttaagactcacaaaactatgattattttgatggcaaacttgctttataaaatcaagctcgatgataaggataaaaagttgctggctaaatctttgaaaaaaaacaaagacttcttatcatcggtacagatggcaaaaaaggaatttgatgcagctgatatttcaatgattgagagagcattgaattatagatacaaatacagcacatactaaaaacagaccatggtaaagagttcgctaactatcagacaattgagcggcgaactggtacacaggtttattttgcccatgcctattcaccacatgaacgaggcagtaatgaaaatcgcaaccgagtactacgccgcttcattcccaaaggtcaaccgattgatgagattaccgatgatgaattgattcaaattaattggtatttgaattcacggccacttaaatgtcttaattggcatacaccaatcgagatcttcttgcttaatttacgtcattaaattcgttcaagttatttcttgcaatctgccttggataaaaaaattgtgttttcgtttttataagtgtcaacttgacaggggatagtaccactgaagaaaattcatcaatcaaacaacccaaatccgaatttgatcaaagtttaaagcgttagccagtttttaaaggtcatgctataatataaacagaaaaaggaagtcccgccgaaaacaggacttcccgtgcaagccgcttcaaaggcggtggcaagttattcaaacgataattttgtcgtcctgcaacctaccaaagttgagcagggcggcttttttatttgttccttttgtcgatatagctgagtagcgcgattaaaaacgtgccaaacagcaacatcaacgagagtgtctggaagacgctcattgactgtgaaaccttcctgaagattattccatgttcccatgggcctcacctcgcaagggaaaagacagccaccgcccttaaaacttcttgctcaatccattatacagggaaattaaaaatcaaccaagagcaataaaaccgctcttgacagcaaaggaaagctacaacactagcaaggtcagcaagcaaggctaataatactgctgcaatgggaaataacaagcgtccagtagggcggtccaagagcgggcgcaaaccctactagacagtacgattataaaagtaaagaaggtcataaaatcagctactagagggaaaactgtggtaaaagacaaataagatggtgaaatgatgactataaagtcaagtcagataaataggtagatgagcatataaattgcttttgacgctttacttacttataatcagtgcaataacaaatgactagtaaaaggcgggtaaaacaatggataaatttaaaaatattattattgggtttggtaaggcgggtaagacattggctaagtacttggcgcagcatgatgagaccgtgcttctgatcgaacggtcaaaacaaatgtatggagggacttgcatcaatgttggctgcctaccatctaaaaatttaattttaaatggtcaacgtggcttagactttactacggcagttaataagcgtggtgagatgactaaacagttgcgaaacaaaaactatcacatggtggctgatgagccactagcaacggtttggaatgggtcagcccgttttatcgaaaatcatgttttggcagtcacaatgaatgacggaacaactaagacggtgcgcggtgaacgcatcttcattaatactggagcggttccaaattggccatcaattccagggttagaattcggtcagcggatttttacgtctaaagaagctatggaattggagaaacaaccgaaacaactagcaattattggtggcggttatattggccttgaatttgctggaatgtttaattcctttggtacgcatgtaacgattttcgatcatcataccagattgttaggacgtgaagatcctgatattgcaaccgaggtcgtagccgatctgactgacgcagggatcgagattaagccggagactcaactaactcaagtaaaagataatggtgagaaggttacattatattatcaacaaggtgatcaaagtaacactgcggaatttgatgcggtattggttgccgttggtcgacggcctaatataaatagtttaggactagaaaataccgatattgctttaaccagtcgtggcgctattcaggttgatgatcatttaaagaccaccgtacaaaacgtttgggctttgggcgacgttaatggcggtcctatgttcacttatatctcattggatgattttcgtattattgtagatcaattgtttggtaagggagatcgctcaacagccgatcgaacggtgataccgactgcttcgttcctaaatccaccactggctagcgttggcttaaatgaacgtcaagctaagagtgccggttatgatttacaaaccttcaagctatcagtcaaggcgattccaaaggctcgtgtcttggaggatcaacgcgggctttataaggcaatcgttgatcaaaaaacacaccttattttaggggcaacattgtatgccgctgaggctcatgaaaccatcaacctaattgcattggcaatgaaggccaaattaccttacgaaagattacgcgacacgatctatactcatccaaccatgtctgaagccttgaatgatctttttaaaaccccggttgtgaaaagctaacgccctagaaaaacaaagccgactagttaatcgaggaaatgtaaaggtcaagctgtggcgacttttgtggagcgtaagagtcgcctgacaattattaaacggctccatggtcgcgacagtcagtccatgactcaagccgtacttgaactagctagtcaacttcaaaacaagctcaagacgcttaccgtagatcatggtaaagagttcgctaactatcagacaattgaacggcaaactggtactcaggtttattttgcccatgcctattcaccacatgaacgcggtagtaatgagaaccgtaaccgagttttgcgacgatttattcccaagggacaagccattgaggagctgagcgatcgccagctgcttcaaatcaattggtatctgaattcccgaccacttaaatatcttaactggcacacaccaatcgagatcttcttgcttaatctacgtcactaaattcgttcaagttatttcttgcaatctgccgagttaaaagatattgacaatcattggaaagaaatgtgtgagttaattaagcctgagggagctattgcttcgattaccgaaaataggcgacctatcaatctacgtttattaactcaaaagaaagcaatctctgcttgggaatggatgtatacaaagtcttactatcgtacaaatgatatgcaaacccaacatgatattttagaaaaaattgcatattttcttgataatggccaattaaagtgtactccaacacattccctttctcctttaaatgcaactaatcttcggaaagcacatagtttagtggaaagtgggcatatgattggtaaagtcgttgtttctggatgggaggaataaaatatgatcgaaaacgacagatattatcgtcgctatattaaagatgtcaaatcgggttatattttcttacaaataggtaaagtaaccctaaataatgagcgagatttgcgaagcaaaggagatcataaaaccagctactagagggaaaagtgtggtaaaagacaaataagatggtgaaatgatgactataaagtcaagtcagataaacaggtgattgagcatacaaattgcttttgacactttacttacttataataagtacaataacaaatgactagtaaaaggcgggtaaaacaatggataaatttaaaaatattattattggatttggtaaggcgggtaagacattagctaagtacttggcgcagcatgatgagaccgtgcttctgatcgaacggtctaaacaaatgtacggaggaacttgcatcaatgttggctgcctaccatctaaaaatttgatttttaatggccaacgtggcgtggacttcactacagcagttaataagcgtggtgagatgactagacagttgcgaaacaaaaactatcacatggtggctgatgagccactagcaacggtttgggatgggtcagcccgttttatcgacaattatgttttggcagtcgtaatgagtgatggaacgactaagaaggtgagaggtgaacgtatctttattaatactggagcagttccaaattggccatcaatcccagggttagaatttagtcagcggatttttacgtctaaagaagctatgaaattggagaaacaaccgaaacgactagcaattattggtggcggttatattggccttgaatttgctggaatgtttaattcctttggtacgcatgtaacgattttcgaccaacataccagattgttagagcgcgaagatcctgatattgcgaccgaggtcgtaacagatctgactaacgcagggatcgagattaaactggagactcaactaacgcaagtaaaagataatggtgagaaggttacattatattatcaacaaggtgatcaaactaacactgcggaatttgatgcggtgttagttgcagtcggtcggcggcctaatgtaagtagtttaggactagaaaatactgatattactttaaccaatcgcggtgctattcaggtcgatgatcatttaagaactacagtacaaaacatttgggctttaggtgacgttaatggtggtcctatgttcacttatatctcattggatgattttcgtattatcatagatcaattgtttggtaagggggatcgctcaacggccgatcgaatggtgataccgactgcttcgttcctaaatccaccactggccaacgttggcttaaatgaacgtcaagctaagagtgcaggttatgatttacaaaccttcaagctatcagtcaaggcgattccaaaggcccgggtcttggaggatcaacgcgggctttataaggtaatcgttgatcaaaaaacacaccttattttaggggcaacattgtatgccgctgaggctcatgaaaccatcaatctaattgcattggcaatgaaggccaaattaccttacgaaagattacgcgacatgatctatactcatccaacaatgtctgaagccttgaatgatctttttaagaccccggttgtgaaaagctaacgccctagaaacacaaagccgactagttaatcgaggaaacgccgtttggattattgctggcactcgtgttggcaacatagtaaaccttgcctggcgttaccaacgtgttgagatcagcaattgacgtttcagcgttaaagaaactgttaacgtatgcttgcatttggtcagtagtaggcacttgcttgctattaattagcgcgttgtacgcgtcaattgtgtcttgcgttgctttaagctgtgatgtcatgccggtaaaagctgagccgtttaaaagactgctaagctgtgccttaacttcgtcagcctttgcctgtacgtcagccactgccttctccatatctgattgatatggcgtagtgttaacgcccatctcaaccatgttcggcaggacatgcagccaaacgttgaccgttgataccgtacccttgctgtcctgcacgtaaaagtaggtgctgtccttgtcccagtcaccctcatacttgaacatgccgcccggaaagtagtacgttatccgccctgcctgagcgttgtcgccaggctgatccgtgtcagcccagccaacggcacgatacaaatcgccaaccgggtctttgccggcgaaaccgactgaccggctgtctttagttaggtcgtatggcaatccattggctttaatccatagcttgcagaaagccctgctgtcgccaacccggccttgaaaatttttggtcaagtcgactagcgttgtactaggctttaagatgtcaagctcgacatactcgttaactgccatttttcccctcctttacaaatacggttctatataatcaaaaagtaggtctaacgtctcgttagccgacttgaaatcgttgtttaagttgttcagcagctcatcgtttagcgacaaactgttaggtatccatagtaaaacagtgctagttagttcaccggtttgctgatcaatcagcgaatgatagttgtagcatgcaatgacactgttaaccactgtctgtacgttctgcattaggtgcttaagccagatgtaggcgttgcgattgatcagctcgtccgacaagtccggtaccgcatatttaggcacgtcagcatccataaaaatgccattggcggcatttaacagccaagacgctttatcgtacacgtgctgtacacaagttcggtatgagcttgtcagtgtggttaaatcactcatcagtacatagcctttttgatagtccatcagttcaccccactacgtccacaaggtggtttgacgccaagcagtccacgtcccatctggcagccacgaacgaacgtaaagctcgttgttgtgagtgtcatgcagaaactgcgtaccgttagtaccagtagtgcttgcaaccacaatcatgttggcatacgtctgaccggataaagggctatgtgtcaacgtctgcccgttggtgtagtagtagccattggacttaacgttgtttaggtcagccgtgcttaggttgcttgtagcgattgagccagggtcgcccttagggccttgaatgccttgaataccctgtacaccagtagcaccggtgtcgcctttgtcacccttatcgcctttagggccttgaatgccttgctctccttgtgcaagaagcatccagtattcttggtcagttacgtcttcgccgtcattagcccgcacgcagacatagctgtggtcaccattagatacaatgtcgagtacgtggtagtcagtattgagctggaaatcgccacgtgcatgtacagtgttagccatctagtcaccccctttcgttagttccattgagttgtctgacgccatgccgtccaggcgtcattgtgcttgttgcgtatataaagactgtccgacaccgtgtgcatggtctgagtgatgatttcgccggcgttaataactttaagcagcccagtctcgctgttgggtttaccattaacgtttgtcgaattgacgccatagtatccggatgtagttagcccatcgcacgtgccagaagtaactgccgtaactgcaaacgggtcggtcaagacgtcgttagggtcatcaaccgtcaaatgccagtgaccatcatcgctgatgtatggcttatagctcttacccgacatgccagtagcaccagtagcaccctgctcgccttgtacaccttgcggtccttgcgggccttgaataccttgcttaccttgcggaccttgcacaccttgtgcaccagacatatcagtgaccagtgatgccttaccaccagtccatacaaacagtttggcgttgtcagcgtcatcgacggtcgagtcgatgattgcaaagtcaccttcgctaagatcgtttggcccgttagcgttaagcattgctacggttgcataggtcttcttaatgctaaaagacttgccggccggtccttgaatgccttgttgaccttgaataccctgttcgcctcgtgggccttgaatgccttgctcgccttgtggcccagtttgaccaggggcaatattagtgggtaaagtgcgactattaaagcgaaggagcgcttgatcactgtctaggaggcggccaatggtactaggtgacaccccaacaaacttagacacgtccttttgagagacattactttcaagcatcgtcagggccttagcgcttaaggttttaccagtcgtatcatcaatataagtgacgttggcggcttcttggtttggttcataagtcacagtgaagtccaaattatcagaattactatcaatacttttaacagttgtctgtgttaaatcgttacctggatcagttgtggacacgacatgttgaccaataacacttgggttgatgattgccgcaaaatctgtactattgccctgagtccaatcacctactggtacaccattattattaatagttggttgaccagattcagtctttgaatagtatgtcgctgtcgaaccatcaatcggattggtaatcgttacaaaactagttggtattccactggcatcatttgcaactggtttaccatcttgaccaatatagtgtacggtttcggttaccgtcttaaccttactagtactgtaagctggtgcataaacaaccgtaaaatttaaatcatcagacgtgttgttaacagtttgaatggcaacgctatttagatcagagcccggagcagtggtactgataaccttatatcccttaactgttgggttatcaatagcacaaaatttagcattatcggcctgaatccagctgctatcgggtttacccgcattgtctaaagttgggtcctcctgactgccgaacttataatacgtggtagtcccattccatgctttaactgtgataaaggtaatagggttagcggtataactaggggcaactgttttaccagtttggtcaacatagttaatagtctcattaacttttttgttattaacaattgagtaagtgacaaagctcaaaaaatcagagttcttattatgattaccatgccaccaccaaggatgattaccatgccaccaccaaggagcgcttgaagcattgattggaaccgcgcctaggtaaagtgttggtttattcgaagtaaaattggcaaaggtcactcccccttgtagagcataataatccggattactatcctcaccatcatgtgactgataacccgaaggatcggtgtttgtatagactaaaccatttggaacattgctacctgaaacacttgtgagtccaattgttgatgctggtgctgtgaatcctgttgatggatcattaataggattttttgagatgactacggttttggcatcattggtttgaacgtattcacggcggttactatttacaccattattagagcttaatgaagcagacaaaaaataaaaaatttgattgttattttgagcagcatgagcctgatcaaatttggtaatgtctacgattgagcgatcatcagagtaagtaaaccagaaggtttcttggaagttggcattgtagacatcgatgttatcaacagcattcgagctaattaaaataagatacgggttgtttgtatcgacaccctttatgctactaataccatcagtacccgggttattttgggcaacgaaatcatgaaatgtttcatgaaagtcaacatttcgtccgttaattgatccagcgttagcccaattctttgtaatagatacattactatttaaaagatcagcccctgaatacaaccaaaatttgtccccggtcataccgtcattcttaaattgctgaggcagattagcctgggtgtacgtacctgttaaatttaccccagttgcagttggagcattgctatcttgagagttcgattcaaagcttaaattttgagcattatctaatgatgaatactgggttttaccatcaccattcgtttgagaagttgccccatcgattggggctgaattatacgcaactgttgcattatcggccattagctgaacaatactcttcgtatcactggtactgcttgttgcagtagctgctgattgagcagcactcttcgtatcactggcactgcttgctacagtagctgctgatgaaccagcgctcttcgtatcactggcactgcttgctacagtagctgctgatgaaccagcgctcttcgtatcactagtgctgtttacagtggcggcagttaagttccctgaggtggtatcagcatgaactgctaccgttgataccccaccgaagacaaaaaaagacattgtagcaattgcggcaaaaacgaattttttgccatctttatacattttataatgtaatttcttttctcccattataaattccttcccgctcaattatattgagctaacctatttttaattatatactgaaacttgaaagtttcaagttgccgaatcaagcgactgtccttttagttaacactgctatcacgatagatcaatttggtggggagggtgatcaggtaaataggggtgaggggattcgcaatcttttctagtaaaacttgaagagcctttttacccatctcgtgcgtttcaacgtgaacactgctgagggagggattggcatattcggcgattgaagtgtcgttaaaggaaatcacgcttacatccctagaaacctcgatgttcaggtctgacagagctttgagtgccccaattgccatcgcgtcgttagcgatcaataaggcattgggacgatcatcaggtgaaagtttactgaagtcttggtgaatcacttggtaaccagattcggggtcgaattggcctaagaagacccactccgggtgatagttaccctgactttgtagttgccttttgaagtcttggaagcggaagtcaattaagtcatcgttagtttccgtcagatttaaatcaccggccagcatgccgatcttctgccgcccggtggcaacaaagtgttcgatgatttgctcagtggcggcggagaaatcggtaatcaccgaggagaagcccttcgtcaggtagtttccgtccacaaagacaacggggattgttaactgatttaggacgtcaatctgctcatcggtatattgattgctaccaattacaattaccccatctaatttgccaaggccatcccaaaggtcgtcttgataataggtggttaggtaacattggtggtatttagcatattcttcgattcccatgtggatggaagaatagtagagatcctgtaattctcgctcccgacgacaccacagaatcaccccaatccgggtggagcgggcagggacgtttttgcgaaccggcttttggtagttgagttcttcagcaatcgcaaagacccgtttcttggtttcatcgttaaccgagagggagggatcgtaattcaggattcttgaaacggtcgatgttgcaatgtgggcgcgttgagcaatgtcttttaaggtcgccattttactttcccccctgagtgatttcttttattttaagcgttggaatcgtcaattactaggtgaactctttggtaaacttattaataattttacttaaatgtttacttaatctcaaattagttatatcatacctgtaagcgcttatggtaacggttaatcccgtgctaataaatcttaggtaggatgataatatgatctatttaattgcgatgattccggcgctcggctggggcttcatgcccatcattacgacaaaagtcggtggttcaccagttaaccagatgtttggtctggcggcgggggcgtccgtcatcggggtaatcacctatttgatctttcgtccagcaatcacggctccccaattctggtttacctttgcgatcggcatcttttggtcaacggcccaagtcggtcagtttgtttcctttaagcggatgggggtctcgtcaaccatcccgatgtccacggcctttcaattaatcggatcctgtgtcttagggatactcttctttggtaactggccgggttcccgccaaaagattattggcctgattgccctggtggtagttatgatcggagtccttatgaccagtgttagcgatgacgtggaagaaagccggattaccccgaagaacgttttatacctattagtaacgacggccggttacttggcctactcaacctttccgaacatggcgattgtcaaaagcgtgtcaccaaccgcccttctattaccggaaaccttggggatcctcactggggccaccatttatgccttcctcaaggatccgcactctttccgacaacgggagcagtaccttaacatcacaagtggattggcttgggggatcgctggtttaacctatatctttgctggtcaggggcttggcgtttccaccgctcaacttttcaccaccgtgggctgtatttatgggacctatggcgggatctacatcctccacgaaaagaagagtcgacgtgaatttacctggatcacttttggaagcatattaattgtattggcttccgccgtaacgggcttcattgcccagttagcggttcttctctaatctatttggctctacactaaatcttgttgatggattaccatagtggtaattcgttgacaggattttttggttttgagggcacaaaaaaaggccccaccagccttaaaattctgattattaactaccacgcaaattcaaaggtgataagggtgacactggtgctactggtgatcgtggcccaactggcccacaaggggttcaaggccctaaaggtgatccagggcctaagggtgatacaggtgttcaaggcccacaaggacctaagggtgacaagggtgataccgggccacaagggattcaaggtcctaaaggtgatcgtggccaaaatgggccacaaggcgagcaaggcattcaaggcccacgaggcgaacagggtattcaaggtcaacaaggcattcaagggccggccggcaagtcttttagcattaagaagacctatgcaaccgtagcgctgcttaacgctaacgggccaaatgatttaagtgaaggcgactttgcgattatcgactcgaccgtcgatgacgttgacaacgcaaagctttatgtctggaccggcggtaaggcatcattggtcactgatatgtctggtgcacaaggtgtgcagggcccgcaaggtaaacaaggtattcaaggcgcacaaggcccgcaaggtgtacaaggcgagcagggtgctactggtgcaactggcatgtccggtaagagctataagccgtacatcagcgaaagtgatggtcactggcatttaacggttgatgatcctaacgacgtgctgaaagacccgtttgcagttacggcagttacttccggcacgtgtgatgggctaactacatccggatactatggtgttaattcgacgagcgttaatggtaagcccaacggcgaaaccggcctgctcaaggtcattaatgccggtgggatcgtcactcagaccatgcacacggtgtcggacaatctttatatccgtaataagcataacggcgcctggacggcatggcgtcaaaccacctactggagctgataagtatggactatcaaaaaggctatacgccgatcaacgatctgaccacgtttttagactcctacggagcttgtacgcaactcgtgtacgataaggcaactaagctgatgcgagccgtcaatgccgtgtttttggacgttgacgtgcctagctggacggtgccaagcctgtcagatgggctgatcaatcgcaacgcctatatctggtgtcggcacttgatgcagggcgtacagacagcggttaacacggtggtagcatactacaactatcgctcgttgaccgacccgtacacgggcgacaaaaacgcaccagtgcagttgtgggtgcctaacagcttggcactcaacggcgattttttgcaaaaaataaacaacgatttcaagtcggctaacgatacgttagaccggctttttaactatgtagaaccgtatttgtaaaggaggggaacaatggcagtaaatgagtatgtcgagcttgacatcttaaagcctggcacaacgctgatcaacttaaccagtaactttcaaggccgtgtcggtgacagccgggctttctgcaagctatggattaaagcaaacggtctgccatatgatctgactaaagacaaccggtcagtcggtttcgccggcaaggatccggtcggtgatcagtataaggcagtcggctgggcagagactgaccaagccggcgataacgctcaagtcggccgggtaacgtactacttcccagccggcatgttcaagcatgagggcgactgggacaaggacagcacctatttttacgtgcaagacagcaaaggcacggtatcaacggtcaacgtctggctacatgttttgcctaacctggtcgagatgggtgtcaacgctacgccttatgtctctgacatggacaaggcggttgctgaagtgcaaagcaaagccagcgaagttgagtcgcaacttagcaacatcttaaacggctcagcttttaccggcatgacgtcgcaacttaaagccatgcaagacacaatcaacggatacaccacactggtcaacagcaagcaggtgcctactactgaccaaatgcaagcatacgttaacagtttctttaacgctgaaacgtcaattgctgacctcaacacgttggtaacgccaggcaaggtttactatgttgccaacacgagtgccagcaataatccaaacggtctggtaactggaaacatcaataaatggattacgaactgccattttattcaacctccttgggatcaattgcttttgccttgccgtctgggacaagatcaggttctttttgtcccaactcgtccggtttcttcgttggctctgtggtaggcgtcagtggtgacttctcgtaggccgcctggacagctgactgaacagttgccatattcacttgaatgccatgattggataagtattttgcaacctgcttagtagcttcatcaaacttctgatgtccaggcatattagcgctgaccagagcattgacattggtcatagctgcctgttcaaggagtgtccatgcttcccgctgttgctgagtcttggcatgcttaattttgctatcgatccagggtttaccgactgcgaagccaaaataaaaagcccacacaagcaggcctgattgaaatccccaattaacgatgtcgtttagtgttttcatcatttatccctcttctctactgcattggttaggtctttaacttgccttgttagactttgtacctgctttttaagttgattcgtctgctgttgtagttgatggacttggctaatcagttcgatattttgttctttaaggccgtcacgctccttagttaatttatcaagacgatcaaacagctctttagtgtggtcagcgtaaacatcttcttgactagcaattgctgaaacagtcttgcctttatagttaaagaaagccccaagagctccaccaaaaagagaactaactactgcaattacaatctctttcacttctcatcgcccccgtaccgtgcttccacgaggacttgaacgaagacaaacccggtcatgattgtcttaatgccgatgattccaggaaagtgaatatcttggactaagaacgtcacaaaataggcacaccagacggcacttagtacaatcatcattactgtttctgcatgatgccggttgtagttagtcattccaatgacggtcgtaattaacccaattgcgatcaaaataaaagcccagtcaatatctcccatatggtgaaagacatgaaccaggcggtcacttggatcatctcgaatcagatgtcgttgaaaagataagagcactccaaccactagtgtttccagtcctgtcaacgttagaaatatattgcgtttcattgtctcatctccttttgtgcaaaataaaaacgccccaaaggaacgctcctaaatttatccatgctttattaaaaacttcagatgtatatggccttgctttattatccgaaatttatttttatttttctttgtaattttaaccttaaacataatgtttcttacttgatcatgaaatactattacaccatccttgtttatctcttcatttaattgtatggttgcatagtctaatctttcagtatgaggccctagttcttccatatctcgaataaatgattccttggttacattaaccggccgtaacctaattaacgatcgagaactgtgtttgagaagcctcgagccttttattatctttagtgctacatcacaagtgctcaaattattaatttctaacgtatcattatctgcaatataaaatcgaacatagtttttattccaacttctagcaaaataaagcgatgtaataacggctgaaatagtcccaaatgcacttaacaagtcagcccaactaccaacttctaatcccaagaacgtaacaccaccaataatcataatagccacttcctcatctcttcaaagaagtatactaccattacaaatttataacagccgcccataacaaaccccatcgtattgatgaggcttgttatgcattgtgtatttctatggcgactatgtgttacaccaataaaaaagaacccaaccaatattcacgagctatttaaggattggcaagatgacgggaaaagggatcacgagcttgattggggaaagtcagaaggtaatgaacttcaatggtaagccaaggtgatatattttatgttaactttaatccaagccgtggtcatgaacagaattggaatcaaacaatgtggttccgatgaagaattggccgcaattgttgaaaaggcgcctaaagattttctcgtttacacgggcgaagatgctcagagcttgaccaccctcgtcttgggtggtcagggaacgatttcagtggcgagtcatttatttggaaatgaaatggcgacgatgcgccgcgccttgaaccacggcgatatcacccaagcagggcaaattcaacgacgtttaatgccgaagatggcagcactattcacacaatcctcaccggcacccgtcaaagcggcgctgaacgcccaacactggttagtcggaagcacgcgcctaccaatttcaccgttaaccaccaatgaacaaagtcaactactcaacagcttaaaataatgcagaacggttggtagtacctggcaaaagcgcgtatactgaaactaaaataattaggaaagtggtgaccatgatgtgcggttgggcttttactggcggtatgccctttatgtggatgggtggcggcttgggcattatcagcttactgattctgttagccgttggtgcttactttttagggacacgttcacgccatcacgattaaagttctcattgggataatcaaaaaagactttcaaggcacggcttgataaagtgaacccttaaaattggacaactttattaagctgctttctggacggtaagttcccggtattttaccggggacttgccgtccagttttgttttgatgcgccgatgattgtagaagtctatccattcgttcatagcttcgataagcgctgttttgatctcaaaatgttcatccataacctcgactttcataatgtgaaaaaacgactccatggcggcgttgtcgagacaagtggctttacgtgacatactctgaaatacatggtgctctttaagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgtattcaatgccatcctttactcgcttactatagggtgtcaatggcgtgaattaccgcacgatttcccagaatggcacactgtctaccgctattacgatatgtggcgagataaaccagacccgacagctgattcgctattagaaaggcttttaaaaaaactgttgcttcctatcgctttgcatagggccgatcggcccgaacatggttcgcagctttaaacatcattgaaggaattgcgacctcattttttacaacgcttttaatggcaatgattcaacaaagttatccagcagaagagttagggcggattctaggcgttttgaattctttgttgaatctagctggaccaattggcttaatttttgccggtcccctagctgatgtgattggcattgaacgcctatttgtgattgcaggaatcggtgctgccatttgcggggtagtcgcggtgttaatgccaattaccaggcaatatgacattaggctgcatcaaaaattggcgaaattaactgagcaaccagataagtaattaacatgatgatcataaagaggagaaagaccagactaccagctgatctttctcctctttttgctgtaccattatcagaaggtattggcggaatatagcccttagtacggtcatcgggatctactggcaccaaaggagtccccatatggtcttcaggtgtatagccaggaagaaaatcaataaccgggtaaccaggcacagatgaatcagcaatcttagtagggtcactaggatcattgggataaataattgattttgtcgagccatcaggattagagacgacccagttgccgagctttctgtaaacatacttaacatcagaggtttgtggaatatatggatttttaattgcgcttgtcgtagaacctacttgatacattatcgcaggatctgagggctttatatttgtccatgttttgagaacttttccattttgagcaattgaagcagacattgttccatctgaaccagtctgagtgtaagtaataactattccattatgaaagtttttaacataactagcaccaatctctccgtatggtgacataacgccatttgaattagaaggtgcagtagcatagtaaccatttataacatttgcgttgctggtcgtataattttggccaactaaccctttttgtgtataaggaacaaccggattaccattactgtcggtgatttgcttgccatctttatcaacgtaataggttgtttgtgtgatcaatttgggtaccatataggatagtccattgtagtagccactatcatatttactagcaatatatttaacagcaagaggatctcttaaactttcaaccatcgcataataagtatcattatagtaggtagtgctatcaaatacagcagatggtaccttagtattttgatttaaagtgtattgttttaaaactttatttgatggcgataattccgttacataaacaattccatcgcccgttcgattagttgaaagaacaatctggtttccataattttttgtttgcaaccattcataactgtaatgagatttatctggatcaatccacatcccagatggataatctggatcactaactgagaaacccgtattggtaactgaacctgccaatacccttctaccatagttttgagcaaaattagttgtaactattgcatcatttttagaaacattagtggctatctgcgctacaatcccggcagtacctggagtaccagcagtaccggcagtgccggcggtacctggagtaccagcagtaccggcagtgccggcggtacctggagtaccagcagtaccggcagtaccggcagtgccggcagtgccggcagtaccggcagtacctggagtaccagcagtacctggagtaccagcagtacctggagtacctggagtaccagcagtacctggagtaccagcagtacctggagtaccagcagtaccagcagtacctggagtaccagcagtaccagcagtacctggagtacctggagtaccagcagtaccagcagtgccgacggtttgtgcagtgactgtcacattagctgacactggctggctggtaactagcatccctaatcccagcgaaaataataatgaaatccccatgacagcccaattcttaccgcatttatataatttataatgcgttttaatctctccaaagtaattattccttaacataaaaaaactacctttctcacttctttagataaaatgttgtcattaaaatcccggtttattaaggctatcgggtcttttcaattagaatagaaactactaatatccccttatatcccttaaatggagcctatctttcgtacgaaaatatttgaaatcattctaaaatcacattattaattaagtatgctataataaatcacgtttattatagcatacttaacaaatttttcgtctgggtagaattctatttaatcttacaatctacctttatcaaatctccagagcaaattctgtagtctgctggcttctgaaaagttgtcgccagatgcacaataatccagtctgactttttcacgctccgtgcttaatacgtcatcggttaccgtttcaaaccacttggagctgtacatattagccttcttgatttcttcattcaggttttcccataaggctttgagagcatctttatttttcagcccaagaacaacagcgataatcgtaggaatacttactccaacaaggataagctgctttttgtgagcctttatccacgcaacaaaacccattctgtcctttggagcttcttctgttgctggttcttcgtttacaacgatattttttctttctcactcatactgtgccctccgcatcagaattttctgtcggtaaataatacactttgccacccttggatatcagctgaacatcctccgcatacaaatccgttgtatcgtatgcgtgtgcgcttccagcagattgagctttgatcatcgttgctgtactcttctcaatagctctaaagtttagatcatcgttaaataagcccggaaggaaatggactacaccatcgaaaccagctcttttacggcgaacctcagatgtatcaatgctcaaacgttcagtcgtggcctgatgccatccagtcaaccggcgctgtgtttcagcaacctgatttgtgtatgtaggtaacaaggcaatgcagtgttctctggatatggcacccatatgcaatgtgtatcgcaactcggatatcttgtaaaggacatccagaagtgatttttgatacatataccagttctgaacttcaggcaattccttctcataagcagcatagtcaaggtccgttttcttcgtgtaacccgcaagagcaagattggcctgtccaagaagctgcgtacattcctcctcaaggctatcgagttgtgaaatttttgaaagtctcaattcgtgattttcaagaatttccacctgaaaatctgcaatcttcttcacatgggctatcagcgaaaaaactctgctgcggtactcgttgtcttgaaaatccgatatcttagaaatcccttcactgatttcaccaagctcggcgttgatctgagtcatataatactgacccacaaccatcgatgctacgcccattgccgctgctgcagtgtttgctacaacagccgtacctttttgagcttcgacagccaccaagtttgcatggccacgaataccgtcagcaccatgataaattccacgaacggcgccttccatagccttcgaatcggtcaattttgcaccaacgggtataattgctctgtaaagaacctctccgttagcttgagctgcctgcgccgcattgttcaccacattgcccacttgggctaatccgggaaccagattgtttacatgagccagtaccttgctatcggtaatttcaacgagcttggtctcatcggggatggactcggcgggcaacatctccatttggatgacaagctcttgtggatcaccgtctgccggaaccagctgaacttctgccttatctttatcgcttccaacactcacggctacaacgccagatgaagttttctttgttttcaggaaaatcatcatactcgcagcgattgcagctacgatgataatacctataattgcgtattccatattggtcgcacctccattttgattcaaaaacatttgcgaagtcaattcgcttaatttattaaaaagagctattcaagcttcttattttatatgagagtttgatcctggctcaggatgaacgccggcggtgtgcctaatacatgcaagtcgaacgcgttggcccaattgattgatggtgcttgcacctgattgattttggtcgccaacgagtggcggacgggtgagtaacacgtaggtaacctgcccagaagcgggggacaacatttggaaacagatgctaataccgcataacaacgttgttcgcatgaacaacgcttaaaagatggcttctcgctatcacttctggatggacctgcggtgcattagcttgttggtggggtaatggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacacgtatgagagtaactgttcatacgttgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcgaactcgcgagggcaagcaaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccaaagtcggtggggtaaccttttaggagccagccgcctaaggtgggacagatgattagggtgaagtcgtaacaaggtagccgtaggagaacctgcggctggatcacctcctttctaaggaattaatcggaaacctacacattgtcgaaacagtgttcagttttgagactttcaagtttcagattaaaagttaatggtgccagaaaccaagccgtatatcccggccagcgccatcagggtaatggcaagccaggttattttttctacgatggtgaaggggcgttgctgttcttttttcccctggtaaaagaaccaaaagccggtttcccagacgatcgcgctcaacaagaggtactgtaagccagccccgtagagcatgaagaccgtaaaggccagggctaataaggcggcgatcccggaccgcacccgttcggcacggggacgctgggcaaacccggttcccgccaagacgctcttgacggcgtaaagggaaacgaacaggtagggaacgatcgaaagcgaggtggcaaacttcaagaggaccaggtaaccggcgttggaacaaccggccacgatcattaacgcctgggttaaccccgaggtgaccagcagggcgttttgcggggcttcgtgcttatttaggcggtttaaccacttggttgccgacccggagcgcccggtcaaacggatttcttcggaacacagggtgatccacgcgagcagggccccagtgaccgaaacgattaggcaggcgttaatcagggtgctcccccagttgccgaccatctgagccattaagccggccatcgagggggtgtgaagttgactgatctggctgggcgccagtaagccgagcgataaaacgctggtcccgaccaagaggaggataatggctaaggagccgagggtggttgccttggccacgtctgacaggcgtttggcccgggtggcgtaaatcgtggccgattccaggccaatcagcgtccacatcgccgataagaggacggatttggactgggcaaaaattgagacctggtgccagtggtggctaccggcgtcgaaaaccctggtggaggcaaaagacgcccagaagatcggggcgtggaagttgagtaaggctaagatgataaaggcagccagggggatgatcttgatcacggtggtgacgttgttaaccaccgtactgtccttaaccccctgggcaaccaagaaggtgattagccacaagaggacggaggcggcgaccaccgccggccaggtggtcccgtcaccaaagaagcggaagagggtaaagccaccgaaggccgaaaagataacggtcaggtacgaggcgttaccgactgcgtcgccgattccgtggccgtaattggcaatgaagccgccgaggtgaccaaagagggccttggaccaaccgtagatcccgtcgtcgatttccggttgctggagggtgaggttgcggtagacgctggtcaaggcaaacattcccaccgccacgattgcccacccgattaagatgccgagcgggttagcgttggccgtcatggtggccggcagggcaaagatccccgagccgatcgttccgccaataatcagggcgacgagcccccctaaaccaaccttatttttgatttccttactcatgtttgtcttcacctttttcatcaattctctgttaatttgcgtggatatgcacacaaattattaattatacaagaacccggtgaaaaggtaaataaaatggtggaaaaaacataagcaaacggggctaaggcaagttgcctcagccccgtttttaggagtgtaactgaaacttgaaagctccgagacagactgatcccttggtatcacaaagctcatttcaattattttaaacatttagcttgctgttaatagcgaaactaaccgtttcggcaaaaatgcgaagaactgattcatcatctgaataatttgagtcctccttgcataaagttcatgattaataatcgctttcagcgaatttagaaaccataccagtgcttgagacaactcaatatctggcatggcttcattcataatgaaaaataaatccccaatggttcggtcgtcttcattttgacgttcctgccaggctaacaagttgtaagctatcatgacaattgccaaatggccacagagtccgtcataactttgaacttgtgacttgtctagccgtaaatattgcttggcaactttaaagtaattctcaatttgccatcttcgggcgtatagttgaatgatctcttgtggctgaagggataactgagtcgttgccagtaccaggtagtcatcttgccgggcccgattggccacaaataccaagcggagcttgaatttttggttcccaacatgtgcttcaacgaagcagctatattggtaagcttgcttgggctgatattttgaagcttgcagtcgcttgtataatgctttaactgaatattgccgtccgcgatattgatagtaaaccttgctagaccgtttaagcatgcccacgccgtttagtcccaacttggttaattcacagaacatttttggtgagctgtaccagctatcaaataacacatagtcagctggaacgccatttatgagagcttgcttgacaagttgcagtgaaacgaggttcattttttgctgtgcttggcgccgtctccggccagcaatggttcgttgatcggttgttttagcggattttccaaggacgttttgcggcttcttggaagacattaatgcaaagttgattggtaaaaatgtattggcgtcactccaccccaaggttaaagcccgatagcccttaatatataactgtttgtcatgatcaaagacccgtgctagtaattcggtttgggtggcgtactcacgggaaaagagggtatcgtcaatgatcaatgccaaccgccgccggcggtcaataaatggtcgcaaatgcttgattaaatgacccccaacttgacagaccagacgttgccaattgatccggccatcgttcaaattatttctaactgtgcgactggtaaagttaggtgtttcacgtgctcgataaagcgagcgtcctaggaactttgtcgtgagcagccattcaatgaccttcatcaaactgatttctgaatgccggcgataattcaccaatttggcgagtttagatagaccaatgagggaagtaaattgacgaacaacgttgtgaagctcgttttctgtatttttttgtcttataatattcatgacgtaagtctcctttgtattttggttttggtcgactaaagtatacaacgcaggagagcttgcgtttatttttttgctagaaaagccaataaccacacgcctttggcgtgattatcagctttcaagtttcagggtattgtacgcccaccagctaaaattattcctttcatgatctacttctccttctttgtagtacattacttacagccctaataaactctttaaatgccaagtttttcattaataacaaaaccgaaaaataagctacaatggcaagtgataccgaaattattaagccaattatatatgaatcgatgtttgagttaaccacatagcaaattatcacaacaacaatacaaccaactaaagaatcaaaaatatttttcaaaattgatctgttagaaaatgttcgttttaaaatatctcttccataataggcattcattgttacagacattacttctgctaaaacagtactcagtgctgcaccatcatatgaccatagtggtataaaaattaaattgattgagatgttaaatatcgctgtaataatcgtgttttttagaagatacttttctcttttagctggaagtaaaacgcaatcggaaaaaatccagctaaatagtgagaataaaattgcccaggcaataattgctaaagaagtagaagcctgtatatatttttctcctgcaataattattacaatatttttgctaagcagcatcaatcccgtcatagcaggaaaagctaaaataattaataagttcattagcctatttaatagagcatggtattcatcaaataattttttaccatacagagcggagagccgtggaattgtcacgattaaaattgcggttagtaaactcgcaacaattgtataaatctttaccgaaacaccataaataccaacttcataatttccctttattaaaccaagaatcgtattgtcagatgatacatatatattaactgctactgctgatgcaaagataatcaagataggttttaaatgagttctccattttgttctccataaaaagcgtaaattaacaaatgattttgcatgaatataattcaagatattcgatcctactgaagccaataccgttatccacgcataaacaaaataatcagtagactttttcacaaaaacaaataacaagataacagaaactattttaaaagcaatatttctacttgttatatacgcataatcttcatagataacataaagccaatttgtccccaaagtggtgaataatatttgaacactgaaaatcaaaatacatagtgcataggtatttaatgcattaaagattaataggctcaataccaataaaatgtacgctatcagtgtagaaatcatattaagagtgaatatctcactagaaaaatcactcattttcctataattatctctaaatttagctccctctctaaccgcatatgtagtaatgcccaaaccagcaatcaataaaaaatatcctacatatatatttgaaaaattatatattcccattccatcaacggaaagaattctagaaacatatggaaatgttattagtggaaaaattagatttaatacactttgtaagccattaagaatagcattaatacctagcgactttctatttttcaaactcattttctcattcctcaattttcagtaactttcctttttatacttgataatcaaaatatatatcgttctaagcagtttatggattgaagcaatggcaattttcttgaaccccttcgtttgagaaaattgcttttttcgttcatagtaatctgctatatgacatggactagtcttagccgctagatcgatttgtccaattgcacgataaagaatcttccgcgcaacggcattgccgtgcttagagatccttaaactagaatctttttcccctgattgatatctacctggatcaataccaacaaaagcatttatcttgtaatgtaatggattagcaaggttgcggaatcaagtagacacgttctcgggggcgatttcgattaaatcccggctcaccacataacggttaatcctatggcccggtggtgtgaggtggtgaccaccataaagggtcagggcggttcattggtgcttacaagcacggtggctattaacaatgcttacagggcaatgattgtaagggttagtagcttgtcaatatgacagcaactcataggattaactaaacatgcgcgagatggccgatggtcaagtaagtagttaagttggaccctagtgcgacgcttattttttttaatttgctcgtagttagggtacaactttgccttccgccgctcaattaacctcagatcaagcaggggtgacccaataagtcaactgattagagtaaatacatagcaaaatttcactaacttttgagaaataataatcccgttaaatcaatgtttcggagtgttacctaaactataccaatttaggttcacaaagttggtaaataaaaagcccataaccgcaaggggtaatgagcttacttgatataatgtcaattatgtcaactagtgaacgttctccaaataaattgcttaatttttttagctatatttacaaatagtattattagagctataaaaactattacattatttgaattattttgagtaatgaaaattaaaatacttgtacctgttaattctaaataacttagatatatgagtaagatataactaaatgtattaagcatttcaatccgtggtttactatagttttctaataaatattgtttacctaattcttgagaatcatctagcaatttacgatcattttcattttcaattttaaacgaattttcaagtcgcttaagccgttggaactgtgttttttcaaaaacataataacaaactgtataaataataataaatatagcaattaagtatattattttttcgctaaacggtcccacaaataaatttctatggaagtctctatatttgtaaaataaacccctattaagtaaacatactatgaatataatggtgcaatttatcactgccatattgcccgttgcttctctttttggatcatcaccaaataatgcttttaataactcccttatgcccaattcttggttctcctttataaattaattttggtactacttataatatagtaaaagttgtatgctatactatcttagcaaatggaaacgttatcgtttgattcaagtgcgttaaagaagtttgttcacccaaacgaactcggtgaaatgcaggcgatggtgaccgccgccgacagcgagttgcgcaacggcactggggccggcgccgacttccgcgactggctgtacctgccaaccgactacgacaaggacgagttcgcccggatcaaggcggccgccaagaagatccaagccgattccgaggtcttagtcgtaatcgggatcgggggctcttatttgggcgcccggatggcggtggatttcttgcaccactccttttaccaggcccaaaccgcggcggaccgcaagcaaccgctggtcctctttgccggcaacagcctctcctcttcttacatcgccgacctgattgacgtgatcggcgaccgcgacttctcggttaacgtgatctccaagtccgggacgacgaccgaaccgtcaattgccttccgggtcttccgccaactgctagaagacaagtacggggtcgacggggccaacgcccggatctacgccaccaccgaccgtcagcgcggcgccttaaagaccgaagccgacgccgagggttggggaaccttcgtgattccggacggggtcggcggccggttctcagtcctgactgccgtggggctcttgcctattgccgtttccggcgccgacatcgaccaactaatggccggggccgccaaggccgaagctacctacgtcaacccggatctgacccaaaatgaggcttaccagtacgccgcttaccgcaacattttgtaccgcaagggatacacgaccgaactgctggaaaactacgaaccaaacatgacgatgctggccgaatggtggaagcaactggccggtgaatccgaaggcaaggaccaaaaggggatttacccgtccagcgctaacttcaccaccgacctccactccctgggtcaatacatccaagagggacgccgtaacctgatggaaacggtcgtgaagctggccgaaccaaaccacaacgtcaaggtgccgagtgccaagagcgacctcgacggcctcaagtacctggaaggcaaggaaattgattgggtcaacacccaagcttaccgggccgtggtcgctgctcacaccaccgggggcgtgccggtgatgaccgtcaacattgccaaagaagacgagtttaccctcggttacctgatttacttctttgaagtggcgatcgcgatttccggttacctaaacgggatcaacccgttcaaccaaccaggggtcgaagcttacaagaccaacatgtttggcctgctgggcaagccgggctttgaagaaatcggtgaacaactcaagaaagaaatatttttcaagcaacttaaaaatctcctttttcggttttctgtaatttaaagagcataaggggaaatataccaccgactagtctgtggcccgccagtgacggggatttgacgtggataccaattttctcggttcgcacctataatgcaccctcaacgagtacgttttgctgcccaaaatgactccgcaatgcgtccatcagcgatttacgaattctgcacgacacaatggcttctgaaatggctgacaaataaaatccctgcctcgattttgagacagggatttcattttttaagatttttaggatagatatgagtaaacgataaactacttcaattaagcattgggctgttcttgaattcggctgacaaacagtgcgccgctggcaaaaacaataccggccaaaaggagcatccccggcatggacttgccaatcaatgggaagatggcaaagctggcaacggaagcaatgatttgcggcaggcagatgctgcagttgaacaatcccagatatgccccttcatgcttaccggccagcgcagtcgtcagcagggcaaacggaatcgagttcattgaaatccagccaatgccgatcagagcgaaagaaagaatcaaaagcatcttatcgtgaatgaagaacactgacataaagccaagtccgccaagaaccagacctaaacgatacatcgtcttgcgctggtttggcttggtctttgacagaaccattccccacagtacggctgaaatcgactgaaccgcggataaaacaccgaaccagttgccggcagcctgatagccagccgttgacggatcagttacattccagacattctttgcaacagcaccagtaccgtaagtccaaaggtattggaacgcaaaccaacagaacatctgaacgagagagatctgccaaaatgccttaggtgcgttcttcagcaaagttgcgaaactaagcttttcttgattggctgcaatatcaacgccatggtacttggcatagtcttgagggttgtattcacgaactttggccagcgtgaagatactggttaagagcagtatagctgcgcccaggtagaaggtccagatgactgagttaggcaaggagcccttcttagcagtattggaaacccctaaaagcgtcatgatgaatggcattaaggttgctagaattccacccatgttagagaagatttgttgccaggaccaagcaaagtctttctgatcctcgttaaccatatcaccaataatcatcttgaatggctgcatgcagacgtttgaagacagatccataaacagaaccgcaattgcaccaaaccaaatacacctgttcccatgccgaacacagaagttaagcttcagcacgccgaaagtagttgggggatcgccccctgcgaggataggacgttgccacgcgttattccggattagctcagtcggtagagcacctgactgttaatcaggctgtcgccagttcgagtctggcatccggagttcttcagatggtgttggtgcgaatcagcatcagcgccatcttttttgccaacttagctcagctggtagagcatctccctcgtaaagagaaggtcggaggttcgactcctctagttggcattgtctaaattgctaggggcgctaaccagtgtaaagaaacactgatataacagcgttcctagctttttgtttacatggataaaacgtatctacacatagaactggtgacaagctggtgacaaattatactgccgggcaatgtggccgtggttctttacggaacgacggctttttttatgggattaaatggacaccgataattttaaattcttttttttccattcaaggctgttactaacctgtagcgggctttacgtaaacggttctgataaacgtcacgtgtaagatccatttcttccatagttttttttgctggttgatggttaataaaacgggcagtgatcaattgctggtcttcttcagacaactcttgcattgcacctctaaatgcgtggtaagcattcagcaacaactttccatcaagcgggaaacgatcttcgttagcatactcagttaacttaaagtacatatccattcgatcgaaacatcgtgtatattcttctgaagtctttggcttaaaaaagttttttaccgtaatgtccattatgaaaacctcctctatataaatagcagaatgaaattcatttcttgcgtaacatgcgtaacaggtaagcctaatcgcttgcgggagtaagttcgaaccctgttacacatcaaatcaagttgcgtaacacatgcgttacactatgagtttgctgtgtaacagcgtaagaaaaaaagaggcgaattaatcgcctctagatagaaaactacccacataagacgatttttgtttcgtctgagggacgctctagtccatagtttttcgcaaaattaagcaaagcccggttctttaagttgttgagtccgcgtaaagaaatatcgaatctgtcgcaaagctcagttcggctatattctttatctataatgtaatggtcaatgataaagcgttgctgaggatctggaatccgttcaatggcacgttcgatcttctttacttgaaaatgaatgtcaacatggttaatggtgaacccacaagtttggacaactaaattaagctactaactgattggcaagttctcggtattgtactggtgacttgccttttagcttggtcctgattctacggttattataaaactcaatccattcagtcatcgcttgcgcgagactctctggattttcgaagtgttcatccatcatctctgctttcatgagatgaaagaatgattccatggcggcgttatctaagcaagtcgccttacgggacatactctgaaaggtatgatgagttttaagcgttttttgccactgcttatgttggtactgaaatccttgatctgtgtgtaccgttgttcgataaggaagctcaggtagtccatctaatgcttcttttagtggcttcaacgcaaactcaagagttggatgtgcactaatgttaaatgccaaaatttcacccgaaaataaatccatgatgggctctaaatagattcgttcactttgactcatctgaccgtatcgaaattcactaacgtcggcgacaagtttttgatatggtcgatctgtcttgaatcgccggtgtaacttgtttttggcgattctaccaacaactcctttgtatgagttatatttacgagtttgcttattaaaggcctgacatgtccagccttgttccttcataattcggaggacgcgtttgtgattaactttaaatccctgttcatgcataactaacgttatgcgacggtaaccgtatttttgagtatacttggcatctgtttggcgaatttcatcaatggcttggataacctggtcatcatcatattttcgtccctggctgtgcttagtgtaatagtacgtgctacgtggcatcttaacggctttgaggataaaactaatcgacgttttgaagactcgcctcagatcatcaattaaggtcacgatttcgcgtgagctgatttttcgtgatctaaggcatcgagtttttttaggaattcattctcgattcttaacatcttattttcttgcttgagttgctttaactcatctttatcgtggcgtgcttgaatttgtgctgttgtgggtttggttacttttttatgcttagccatagtctttggatctcctctcactctatttaggccactgagtccctttaaatcaaactttctttgccattgccagatagtacttggtgaagagagattgaagtgtagtgctgtttctgaaagcgaagcttgactatctaacttactagttatgcttgtggttttgctactggagccacgtaatccttaccagtaatttgcttatactgttctggtgtaatcactaatcccacatatccagttacgtcacaacccaagctaaacatcgttgtaataaaactaatccaatccataactaattgcctcccttttctttatcgttcttctgcacacttgcgatctgttgacccaaagagttaacaagctgaattaaagccagattatcttttgtcaattttgctacttgctttcctaattcgtttagtcctttatcatcagcacttggagtaaccgcaataagactcttttgttgcgattttagataagcatcatgttcttctggtgtagcatctacccatgaaccatttaccagcttagctggttctaccttacccgacggattttcaaaagtctcgttagcttttaatgtatgatcatcagcaacaacgttacttcccttgaaaaggctagttgttgcatctgcataataaattgccttcattatttatccctcctttacttgctaaagtacattgtatgaagcgtatagtcccaaccaccatgatcaaaaggagttgtagcggtattggaaatccataccgtattggcacttgactgtaaggtgtagtaggtactaatcacaacttcatgtaattgataagattctggtcggactaagtctggcaatgtgaaccaatcaccgccatgaaaattatcgctagtcaaagttgagtgaataataatttcgaccaacttttgacctccgggtaactctaagtaacgatagccactcccatcacccaagttaaatccgttatgcattacgattccgtctttgctccagtcatgaaactcaaattcaccataaagctgtttgaagttaccatttaagacactaagccagttcttgtctcctgcttcaatttcattatatgccattagcagtcaccaccttttgaagtaacggaaaccgcactatcagtagtgtttagtttgccacgccccattttagttacaaacgtagtcatattgctacctcctttttaattccattgagttgtctgacgccaagctgtccacgtgttatcaaagcgactgcggataaactcggtagcctcgccatccacaaagatctggaccaggctgctagacgtgcccttaaccgacataaacccagtcttaccttattaggctggtcaggggcaaattggcgatgtaatacattgtcttcaaggtactgttgttgttctttaacccggttacgacgcggttggcgaatgtcagctttgatcccgtgctcacgcataatccgccggacccgtttaatgttaatcgggaagtcgaagctaaaagtgtactctttaatcttgctggtatcgctattaagaatggccgtgaccttccggtaacccgcacagttcaaatggcgtttctcgatttgacgaatcgccgccaaaatcttcgcattctcgatttcttgctgggtcttgatctgccttttcttgagccaaatgtaatatgacttacgcgacgtgtttgctaccgccgccaactcggtcactgtgtaaccttccttaactagttcctgaatcgcttcgtattttgcggatcgtccacctcccgattgcgtatttctctcaatttttttgcgaaagctcgctccacttctaagcgccgaacttttgccttgagttgtcggttctcttcttctaactgttcttcgcgcgttaaagcgtcacctttgggacgcggctttttacctcgccggtcctttaagacttcccagttaccggtggcctgatattttcgaacccagtcatacactcggttatacgaaacgtcgaactccttagctgttacttggtaatcactgtcatgatcaagtgcccactggacaatcttaatcttttcgtcgtaactgactttccgtcccattttcctaacccgctttcctgcgcctttcggtgctagtagtttgccactattgtaccgaataacccagtcggttagttgagaattactgcgaatattgtacttatgaagcacttcctggcgtgataagccgttatcttgatagtcgacaaccgctgccacttttaggtcaattgaataccggcggttggtcgcgctccgcctaacccccagtactccttcctgaaggaatcctttaatccaacgacgtaatgaaccatcgtggatcccgttgtaatcagcgaaaaccttgatcgaaagatccgaatcctgataacaacttagaaaatatagccgatctagtgtcgaatagcttggcaaataaaaatccccctagcgataataagtcttgggtttcatacttgttacctttaaggggattatagcccatggttctaaattggtaccaactggcattcgcaatagctttagctaaatggtgattcttttgtagattcttggctttcaaatcttcaatgacaatcacatcgtattttttaactaaggctgttgttagtttgtgtaagtaatcttgacgttggttcgctatccgttgttggtagcgagccttttgtttttgagcccgttgccaattctgataatcattgagatccatttttacgtctttatgattatggttccattggcgaacagctacggttgcttgatattttcggcgactatacttgctttgccactttgtggcttgcttttccaaccacttagcattgaaagtaccaaacttttcaccgtcagaactaatcgctaagtcagcgatcccaacatccaggccaacggtcttgcctgtttttggcaatgcttctggagcaacagtctcgacctgcaaagataagtagtagcgaccagttggaccatagctgacggtataacgcttaattttgccatttacagcttgagaggtcttactagttcgaatgcttcctaacttaggtagcttcattcttctcttggcaatcactgtgcagaccgaccgaccagtatatgactgtttggcggcgtgcctgcttttaaagcgtggatagccaccacgatgtttaaacagcatcttaaaagcttggactagattatggttcaccacaaggaaactagtcgcatcgctgtctttgagatagggatattcttgtttcaactgtttaagcaagtaattcattccatattcatttacaaaatgactgctaggattgttttgatagcgttgcttagccatatctagcatgagattccacactctacggtcattgccgaacatttgccatagttgagcttgttgttgcttgttagggtacaagcgtagcttgacccctttaattaatttggtcattctaatttcacctcctttttgcgttgatcatcaatatacttggctactgcttgttcattaacgctcccaatgctttcaacataataacttggtgaccataggtgacgaccttgctttttccagtagctagtttgtagttctggacattctcggaagaggtgccatgcagaaatgcctttaagccagcgcatgatgttagttacagacagttttggcggagattcaaaagactggtatcttaacaaatgtttttaaataactgtttgaattataaggaggaaaaattatgcagaatggaacaccaagtgaaaaaacaacaactaaaacaacaactaacgaaaagtctggtgttaaaggcaatttaacatttgatgataaggttattcaaaaaatcattggtatctcactttctgaagtagatggcttattaaccgtagatggcggctttttcgcaaatgttgctgaaaaactagttaatacttccgatgtcacatcaggaattgatgtagaggttggaaaaaagcaggttgcagtggatctagacattgttgctgaatacggcattgatatttctaaactgtatgacaagatcaaaaatgttatcgttcgggaagtaaagaatatgaccgacttagaagtaattgaggtaaatgtgaatgttgttgatgtcaagacaaaggagcaacatgaaaaagattcgacttctctgcaagatcgcgtgagcgatgctacagataaaacgaaggaagcctttagtaagggcgcaaataaatcgaaggaaacattaagtgacagcgttgataaagtaacgtctgacaataaatctagtcgtgttaactaagggagtgagtaaatatgggacttatttggtcattaatcgtcggggcaatcattggtgccattgctggcgcaatcactaaccgtggtgctgctatgggctggattgcaaacatcgtagctggtttgattggtgcatggattggccaagggctccttggcacttggggcccttcattagctggcatggcattgataccatcgatcatcggggcaattattttagttctgattgtttcattagttgttggtcgaaccggtaaaaagtaagggggaattttatggacgttttgaaaagtgtatttaagtttatgatcgcttctacgctcattgtaggtggtgttctcatcggcggcaccgtcttggctgctaagaaggtagatggcattggtgatacgttgcaacaaaaattacatggataattagccaaattatctatattagtcatcttagaacgtaaataatttgacaattaaaggtcagttaatcaatatttcaattgttatgataaccttttgcgttgccacgcgaattggagagttgtccgagctggccgaaggagcagcattggaaatgctgtatacgggttaaagcctgtatcaagggttcgaatcccttactctccgtttatgacccgttggtcaagtggttaagacaccaccctttcacggtggtatcatgggttcgaatcccgtacgggtcactttttggaggattagctcagttgggagagcgtctgccttacaagcagagggtcacaggttcgagccctgtatcctccatcgcaaccatttggttgcaaacctacaccacgatggctcagtagctcagttggtagagcaatggattgaagctccatgtgtcggcggttcgattccgtcctgcgccattgatggaggagtagcgaagtctggttaaacgcgacggtctgtaaaaccgttcctcttggttcggtggttcgaatccactctcctccactttattatagggatatagttaaacggtataactacggtctccaaaaccgtcattgtgggttcgattcctactatccctgctcaactgaatattttggcggtattggtgaagtttggttaacacatcggtttgtgggtccgacatgcgtgggttcgaatcccacataccgcccttctgattagacggggtaatgcccgtctaattgtatgaattgaatagtagatgctcaatggtggtatagccaagtggtaaggcacaggtctgcaaaaccttcatcaccggttcgaatccggttaccacctttgttatcttgcctctgtggcggaattggcagacgcgctggactcaaaatccagttcccgtttgggagtgtgggttcgacccccaccggaggcattccatggcttattgcctttaagcatctcgtgtaatattcagttccaaggcgtccttcggggcgtctttttttgtgtcctcaaaacctaaaaatcctgtcaacgaattaccccaatggtaatccagcaacaggatttagcgggacgtcgttattgccagtggtgacgagcaattgcggccagggacgttgttagctcagtaacgctagcgttgatgttgcccttttgccagtcagtaagaatggtcagtacccccgctaggttgtaattaatttgggagtaataaatttttatcacacattgaataattaaaggagttagaacatgaatttaaaagagccattagtatcaattgtggtccctatatataatgttcaagactttgtagaaaaatgtattaaaagcattttaaagcagacatttcaagattttgagctgttattagttaatgatgggtccacagataatagtatcaaagtatgtaaacaatatatgcacaaagatgagaggattaggattttaaacaaagaaaatggcggcctgtcggatgctagaaattatggtatagatagagcgaagagcgattatgtagtttttgttgatggtgatgattacgtagatgagcggtttatcgaggaactttataaatctattacaaatgaaaaatccgaaatagctatttgtggatatataggagtaactaatgatggagaaatgattaatgaagttagtttaaatgagcctaataatttatcatttataactggcaaagagttattgaggtattcttataagctaaggggagtagtgaacgaggttgcttggaataaaatttataagaaagaggtgtttgacggggtaagatttaccaaaggtaaatattatgaagatagctatatactcgcttccttatattgggatattaaaaaaatttcattagttaaggagaatctgtacttttatgtacaacgctcaggtagtattacaaattcagcaataagcaagaagaaggtaatggatgcaaatgaattgcgtctcaataggataaatttcttttactcaaaagacagggagctgtatttgttagccgttgatgagtacttatattggattgcaggagtagtagctaaaatttatcaagataacgaatttaaggatattatcgaatacctacaaagacagtttagaaagtacagtcttcgtagtaaaaagacgtctctaaaaaagaaagtgcgaactatcatagggatgatgaatattatttggttagggcagattgtaaaatttaagttgaacatttaagtggacagaaaatcccatcaaggtccttaatggtgttaccacacaatccattagaaagaaggaccttgatgagcaccactattttatcattccagaaccaaaaataatcttaatgtttaaatttgcttcacttcaataaaagaccggcctgctcaaacccaagggttttaacggaccgatctttatttacattaaggcatctttacttactttgaaaaatttttaattttcttgcacttgccgaacaccttcctggaccctttcttggccattaacagtcaaagatagccaaacaactcgtcgatcatttggattcacttgtgattgaattaaattatcttgaatcaatcgccaagtattcctggaaattagtgtgcgcgtgaccgtgaatgcatcagataattcactagcagtagcttgcccatgttgttcaagatagactaatattccccactcacgcattgaaaagtcagttttggccagtccttgcactaacatctggtatgcctgattctgaatagcttgcagggttgttaagctctcaaactggttcttagtttgccgatgatttagcatataatatcatcctattctttgcgctgccgcttagtcattccgaagagtcctaacaaactactcatggctaatagtaataagccactcagcgtcatgtgttgttgatcagtttcaccagtttgaggcaaccgttgatccacaaaattagtagccgctgcttgaccagcctgaaccggctttgttggcgtcgctggttgacttgggttaactggttttgctggcgtcgttggttgacttggattaactggttttgttggcgcatccttggtataaaccaccgtgaagtcaagatcactagcgtcaccactcacagtttgtgccccaatttcagcttgatctggcgtataacccttaataactgggctagtcactgccgcaaagctttgatcagctgaccaagacccataggtcttttcacctgtaaccgcatcagttgagacttgacgcgtaaagggcacttgagcggtgttatcagcaggagtttgattaccagcgccttgataatgaatagtttccttaacggttttggcctctgtagactgaatgttttgatgcttcaagtgaaccgtgaaattctgatcagttgtgtcatcattgtcgaacgtcaaatctgctggatagccatcggtgaccaactcataccctttagtggacgttacattttctgcaacaaccactaggggttaatttctataattgaattgtttgaccaacaaaaatcatgttcggattagaaatgtgattctttgctgctaatgcctgccaagtagttccgtgagcagaagcgattccagatagagtatcgccactttgaacggtataggcgttagattggccagtatcaccaagcataatcttttggccaacgtaaatcacgttaggattggcaatgtggttaaggcttactaagccagaaacggttgtgccaaacttgctggcaattccgcttaaagtatcacctgcttggacgtagtaagtattctgtggtgatgactcaccggttaccttcaatacttggcctacttgaagcaagttaggattacccaagctgttaatcgctgctaaggtttgccaagtcgtattgtacttgcctgcaatgccagataatgtgtcaccagattgaacaatgtaagtcccatccgctggcttaccaacgtgttcaactggttgtggtgctggtactggggtacttggtacactaccgcttgcttttccagtggtaaaggcaccgtcaaagtcaaaactggtgtcaatccccatgataccgtgatcggtatattgccaagcatttgcattatcaattccgagtgaagtaaccccatagccggcaatccacttcttccgattgccgaagccgtgactgtttaagatgccaccagtaaagaaactccgcattgagtagacaccggtgctcttataaccaagcgcttctacttcttgaagaaaggctaaggtagcaccttgataatcgttggctgaattaacttctgcatcatcaatcatcagcgtatcgtcatacatgccaaactgccgagcaaccttaacaaagaatcgtgcttcattctgtgcatcgggaattgaagtgtagcgggcaaaatgatagcaggctactcttaagcccactgctagggcattgtgaatttgtgctgccgctcgtggattaatgtaattagaaccatcttcactaccttcagttagctttacaacaacaccttgtgctccttgattcttagccgtttgaaaaaatgctaccgtatcaggggcctcaataagctcggcggcgttagcgtagccgagtgtcctgcgatgcttttgattcagcgcatcttgaacctttgcgatatcatcttcagagaagccatgtagtgataggcctttagggatgtactctcggatcaggccattctggttttcattactgccacgttcccaaggcgagtacgggtgcgcaaagtagatctgagctccctgaacctggtccaacagtttgaactcagagccgttatcgaaagtgatggtcttaaagtagccaggatgctggtcaatggtggcttgaagctcttttaagcaggtgtctgtgtggtagttgggaatcttgacgatgatctcatagcggactcgccgttcggtcagggtcatcagtgctggttcactggcttgacgcttgcctttaaccaggtcaccttcccaatcaccaaagcgttcacggttattaatagtgtccggtcgttcatcaatcgaagtaccagccagacgcttatttttacgcgagtggttgtgacgattggactttacatggcgccgcagcttggctggcaggtcgatattcttaatgtctaagcggccttgatcaatataccgataaacggtcggcgttgaagggcacggctggtcaggatgagtctgcttaaaggcgtgcacgaaaccatcaacactatcaatccgtggtcgccgtttaagcgctgttttaagcatcttaaagaacagccagcagaccttttctagtccgccaaaacggcagttctgacgcgctttatcatgaataagctggctcgtgtccgcaaagtatttggtgaaaaagagatagtcagaattacgttgtcgaatggtgccacgcttaatttcacgcgagatcgtgctgcgactgcgattggtcaggcgcgcaatatcagcctgagatttcccagcattcaagtacgcttcaatttcacctctttcttccggggtaagttgttgataatgcttggtagtgctatgcttggattgggtcatggagatatcctttctttagagtttcagcactttaattttaggtctccatggcctatttgtataatttgaacttgttgcacttagattttaaatccgggatcacctttgtcgcctttcggcccttgagctaagacgcccaagtcaatatcagtcgttgccaatttctcaccgcctttctatgaccagaatgtaatttcacgccaaactgtccacgtcgtaccatcacgacgattgcgtacgtaaacgttggcatcagcatcaccgtagtacgtctgtacaaccatacggccggcaatcttaacatctagcagaccccagttgccttcgttcggaccgttcttgccagtgtttggcgaaaaacgtatatcgtagtggccctcagatgtcagattattaaagtcagtcgacgtacttgtgatcgtgccttgaaaagctgtagcagccggtcctggtggcccctgtggtccggtatcacccttgtcacccttaggcccttgaataccttgtgggcctgttgggccacgatccccagtcgctcctttatcacctttggggccctgcactccagtatctcccttgttgcctttgggtatggtaaatccagacgataaaccggtaaccgtacagcttgttgagctgagcgaagtaatacgccagaaaccaatgtcaacgccattgccgttggggtactgatcaaacacgatgtcgccaactttagcaatgtcgctaggctgtaagtttgagcgagcaaaggtagccgtttgaccgctagaaccgttgccggatatatcaccgttgtacttgatgatatttgcccccgttggcccagccggtccagtagcaccttgcggaccagtcggcccggtattgccttgtgggcctcgtgcaccggttgctccggtctcaccttttggaccctctggaccacgcgctaccacacccaagtcaatatcttgtgttgtcactcactcacctcctaactccattgcgttgttaaccgccatgctgtccatgtgccattgtggcgggtacgggtatagcagtcggcagtcgcactgtcgatatacgtctgccatacttcgttgctattggccctaatcgtcaacagaccactggttgacggtatgttggcaaccgtgccatcgatacgatagctgtcgtccatcgtaaggtcgttagcgttgccctgcgtaatcaagttgaaccgtgccaccgccgttccattttgcgtgtatttcagatccaggtccttagttaatcgacctgttaacaccactcgattaatcattattccacctcaatatcagtcacgtgttgaaaagcagctagctctttcattgatcgacaatactcacactttccgcaatgcttaggctcaacttcgccgttcatcacctgccagaagtgatcctgcttctcttggatttcttccagggcttctttcatcaagtactgtatgtccgtatcctcaaagtcaaaggcacctttgtctggtggagtttgcttgctgaccgcaaaaataaacggctcgcatttataattgaaagactgcttaatcagttctttatagattgctgcctgcataatgtagccccgatcttcaatgaagttagtccaccggtggttattggcgtcccagtgcttcttatggatgtcatcaaccgtcttaagatcacagaagtaacccttattcagaactagactgtcaatcttgcctttccattcgtgatcaccaatcttaccggtgacgattacttctttttaacctggcatatagacataattaaaaagtctatcgttttcaagcgtttgaatcatctggtcagctagcttaaattcggctcgcaagtggccgtcagggttcgccttcgttggcttggtcatcatcaattctcggttagtcttcgcgccggtttctgaccggtctaaccaagcttgatgtgcctctgggctatcaaaatacgagtggatgtagtttccaaccagtaaaggtgtcggacttgaggttggttgccaatcttcattgagcttagctaaagcggcggcttcacattttgtgaagtccttgtacagactaaaactcatgtagtcccagtcggtttcgtgagagtagtagttttctggtgtgagtttaagcattttgcccctccttcaagaaatcatcaattgacatctgacgttcgtcagtttcactcgctggctttgcttctggttcgctctctgacgttttagccggtgctttggggtcttctttagtttttgacttctcgtccgctacactccggtcctgctttttggctttcaatgtactttttgatgtacttaatcagacctgatttgtactgaccgttctcgttaaaagcttgtagcccttcaccgactacttggggaccaaactgcctggctaatccctccaggctcccttttgttttggtggataacatgccccattgtcgttcagtttcgcccagcttctcaggtaatgagcttaatttattatcaatcagccaatcattagttaagttagtattagtacagtaagtattagtagtggcggattttcctacgtaggttttccctacgtaggtttttccgtcataggtaggtgcctgtgacggcttttccgtcttaggttcatcaaacaaaatgtaatcgtatgacgctaactggccattcttcttgtgcttcctagtgcgcttaacgtagccaagactaatcagttcgttaattgcggaccggatgctgtcacggccatctttgaagtctttactaatcgccaacacgtaaaattcccaatcgtccggcttgctccacatataagtgaagagccccagcgcttttaagctcatccgtttatcgctgatgacccggttatcaacttgggtaaacccccgtgtcctaaccttctttactttcggcattgtcgttcccctcctagaaaggtaagtctgttatgtcagccggctggtgggttcccatcctgtcaatcgtttggccattgatagcgtcattagctggcgtcccgttggcgtacatcccaccgtatggcggtagattaggttgctcctgaggcgcattgaaattgacattagcttggtaattgccggtttgctcgctctggttggcgtcattatttcgatatgacagtagggcaaatgaatcaatcctgacatccgttcgataaacctcttttctgtctcggtcggtgtagtggctggtctgaatccgaccatcaacaccaatcaacgatcccttgccggcatacttagctaagttctcggctggctgacgccaaacctcgcacgagataaaatccgtttctcgctcgccagtctgtttattcttgtactgccgactaactgccgtagcggacgagaagtcaaaaactaaagaagaccccaaagcaccggctaaaacgtcagagagcgaaccagaagcaaagccagcgagtgaaactgacgaacgccagatgtcaattgatgatttcttgaaggaggggcaaaatgcttaaactcacaccagaaaactactactctcacgaaaccgactgggactacatgagttttagtctgtacaaggattttacaaaatgtgaagccgccgctttagctaagctcaatgaagattggcaaccaacctcaagtccgacacctttactggttggaaactacatccactcgtattttgagagcccagaggcacatcaagcttggttagaccggtcagaaaccggcgcgaagactaaccgagaattgatgatgaccaagccaacgaagacgaaccctgacggccacttgcgagccgaatttaagctagctgaccagatgattcaaacgcttaaaaacgataaactttttaattttgtctatatgccaggtgaaaaagaagtaatcgtcaccggtaagattggtgatcacgaatggaaaggcaaaattgacagtctagttctgaataaaggttacttctgtgatcttaagacggttgatgacatccataagaagcactgggacgccaagaaccaccagtggactaacttcattgaagatcggggctacattatgcaggcagcaatctataaagaactgattaagcagtctttcaataagaactgccagccgttcattttttcggtcagcaagcaaaccccaccagacaagggtgcctttgactttcaaggcgacaccaagtttttaatgcaagaagcgatcgacgagatcaaagaaaaccaagaacgatattggcaaatcatgaccggtgaagtagcgccgaaacattgcggaaaatgtgagttttgccggttaacgaaggaactatccggattccagcacgtaacagacattgaggtggactaatgattaatcgagtggtgttaacaggtcgattaactaaggacctggaattgaaatacacgcaaaatggaacggcagttgcccggtttaccttaaaattacaggagtattttaccatgacaccagatgaaatcaaagttggccaagtggccaaccaactgctaaagctaagcgaacacatactgacggatgccaatcgcttagtattgcatgaaccaaagacacggagcgaggccattgctgaacatgacgccatcgttaagcaggcagagcaattggttctttacgctaaggattggaaacacgaagtaaccgggaggttttaattatgtatcaaccaactaacgctaaacaaattacaagtgcggtcgctgagcgtctggatacgctaaaggacgaggggttagcccttccggcccactataacgcccagaatgccttgaaggctgcctacttacgcttacagacggttaaggatcggcaagggcgtccagccttaaccgtatgcactgagccaagcatcgccaacgccttgttagatatggccattcaaggtctgtcaccggccaaaaaccagtgttacttcatcgtttatggaaatgaactgcaaatgcagcggtcttactttgggacaattgccgccttgaagcgcttggacagcattgaagacattgacgcccaagtgatccaccaaggggatgagttcgagattggggctgatgaaaccggccacatcattgtgaccaagttcaagcccagttttgctaacttggacaagccaattaagggtgcgtttgcctttatcaagctgaccaacggcaggactgcttacacagtgatgacgaaggctcaaattgatgtttcttggagtcaaagtcgaaatcggcaaaacaaggttcaagacaagtttagcgatgaaatggccaagcggacggtcattaaccgcgctgccaagatgtttatcaacacatctgacgatagcgacctattgacaggctcaattaacgccgttactaaggcggagtacgaagaaccgacagagccaaaggacataacgcaaacagcggccgaagaacaggggagcacggctcaattgctggcggactttaaagaagcccagcaggccgaagagaaggttaagccaaaatcagctcccgtacaagccccagaacagcctgcccaccagtgttccattacggcgttatccgctggtgtcccaggcgccgataggctatgccttaccttctcctgacggagagcttcgttgtaattggtggacgtatatgccgctccacgatccgtatggatcatttctggagtggttccactagccttagcggcttggttaaagactttgattgcggcttctctggtctccgttggtgagattaaccatgctgctggccgttgtccatatagatctaagatggcgtgtagacggactttattagcggtcccgtaagtcagttctgttgtatctgttacccaaacctgattcggcttttcttgcttaaattgccgatttagtaggttttcatcttgataggtttgttttgctccctggcggtccttttttggctgccggtaatccgcccgaattccattaattttcataatcctgctaacccgcttaatccccactctgtaacttaatcggccctctttattcaatagacgaaccatcttatcgtatccaacactatcttgatgccgtttttcgattcgcttgatctcctccagtacttcccgttcctgctgttcgcgtagcgataatctacgatttaaccatttgtaatacgcttgccgactgattcccgcagctcgggccgtttcactaactgtgtactcgccactgctggtcatttcttgaaccgcttgatatcgtttggccgcttcacctcccggttgcttatttcgatcaatttttttgagaaggcaatctgaacctctctttcacgtaatttagctttgaggtcccgaatctctttgagtaactgtttctcacggtcggctggttgcctacccctggtcttgccacgccggtcctttagggccgtccaatcgtttgcttgctcgtatttctgtgtccaggcatacgctctggaataggtaatatcaaacttttgcgctgcttgcttgtagtcatgattatgcttcaagacccatttaacgatttcgattttctcgtcatacgagacctttcgtcccatcttccgcacccgctttcttactggttctttaccattattgtaaaggtcgctggttaatttggagtaacgtcgtcgttaaatcttgatgtatacacagtcagggtgtcattcttgtatgacatctcgtcgatggtttaataaacacggaatcagattctaagaaaaaaactttagtaaacaccctccaaaactataagtaaagaaaatagggtccctattttcttttaataccgtatttcacacggtatcgaataaaggtcgtccgtttaatacctgtatttcgggacacatcaatgtcactcataccagctcgataaagcttaaaagcatgttgcaaacgggggtcatctttggcatattggggtttgcgcccatgatatttaccctgctgcttagctaaggcaatcccttgctgctggcgctcaatgattcgcttacgttcactttcggcctgatacttatagagttcaataatcaagttggtcatcagttgacgtaaatttgggtcagcaatcccggtcatggacggcaaatttaacacatctagggtggcacccttattttgaatggtgttcatgatcttagttaaatcctggttgtttctgcctaagcgatctaattcagtgtccaggacaatatcaccctcacgaatatagtccagcattttttgcagttctggccgattagagttagccccacttaatttatccgtaaataatttatcaacgtcttttaaagccgctaactgtcgatctaaatgttgctccttgtttagtgttggatcagatgggcattaccttgaacatttccgtttccatttcgatgatctttttgctctgttaaaagcaaaaggtgtgacggaattagcgatttatcaaaaagtaaagcgaattatggttccattgccagtctaaaaaacgtcctcagcatcaaaagtgaggacgtttttttagatttctttttctaaaatcggacaaatgcgatcttgttttcctaaaattggtgacttgaaacatcaataaatggattacgaactgccattctatgcgacctccttgggatcaattgcctttgccttgccgtctgggacaagatcaggttctttttgtcccaactcgtccggtttcttcgttggctctgtggtaggtgtcaacggtgactgctcatatgccgcctgcacggctgattggacggtcttcatatcaatgtggacaccgtgatcggacagataggactgtacctggtcagatgcttccagaaacttctgtgagccactcttgtcggaacttaccagcgagttgacagtagtcatggtcacctgctccaagagcgtccaggcttcgcgttgctgtgctgtcttagcgtgcttgatcttgccatcaacccacggcttggcgattgcaatgccgaaataaaagagccaggcaatggctcctgattgaaaaatccacgtaaaaatgtcatttactgttttcataacggaatacctccttctctagtgcggtaatacgttgattacgcacttttgcttcaccttcgtgctcttcaaaacggtcttcaagagtatctacccgtcttgtagtacgattagcagtgctctcgatcaagctcatcatgttgttgagattatcaacccggttaatcagttgagatagcttgttggatagcccctctgtaccacttttgattgccaagtgtaacagccagattaaccccccaccaactgttgaaaagattgtaaccatcgccattatctcgtcccacgaataccccatgatgtggtgcattaccatgcctcctttcaaactcacccagccgtctttcaaacccgcccataagaaaagcccaggtttagcattttgaaagtgctaaattccgggcttttcttatgcattgtgtctttctctggcgagtatgtgttgcatgacgcgcttcttgttaactgtgtatgataatctttcctgctttatcaaacgggtcatcttgtcataaccaacgcagtgtttatgttgtgcttctaactgtttaacgagctttagaatttcttgatcttgaatatcatgaaccgtcggttcatgggtaagccacttgtagtaagcctgccgacttaccccggctgctttaactagatcagataccttatacccactttggctcatttcctgaatcgcttgatatcgtccggccgttccacctcccgattgtgtatttcgaccaatttttttgcgaaggcaatctgtacctcccgttccttcgctttagctttcagctgccttacttcttgtcgtaatctttccacttcattggttggtgttttgcctttatggcgaccccggttatcctgaagggattcccaatcgtgagttctttggtactttcgtacccatgaatagacccgttgatagctgacattaaatttttctgccgcggcttgatagttatactcgtgatcaattgtccattgagtaatttgccgtttctcctcaaaagtaacttttcggcccactttcctagctcgctttcttgttgcgtaagcaacacttaattgtccactattgtaccggacaattcattgatgtagttgggaaagactacgaatttgatatctattgagaattgcttggcctgacagggtacctgaaaggtaagctttaacggctgatcgcttggtttgaagtgtgtacctgtgattgtgttcagggcgaatcaatccagccaaaccagccgttaaaaattgtttaatccatctgttaaggctagaggtccgcacctggtgataatccgcgtataccccgagtgagtagtctgaatcttggtaattactgagtaaccttaatttttcgggcgaattgtcaaactaagtgcaacggtttgtcaaaaaatacttcatatggggtttcatagtttaacactttgcgaggacgttgatttaactgcttttggcagtgttcaacgtcctgttctgtataattatcaatatctgttcgcttgggaaaatattcccggattaatccatttgtattctcatttgttccacgctgttcaggcgaatatggatcgggccaatagacagtaacacctaacctttcgctgatttcatcaagatgaagaaattcggtcccatgatctggtgtaatagaatgaacaaattctttaggaatggcccctaacagttcaactaagcctttatttatctcctgcgagtccttttgcacaacctttttgataagcgtaagccgactaagccgatcgacaaccgttaaaaggatggagtgacccgttcgaccaatcacagtatcaatttcccagtcacctatacgttgacgctggttgataaaaccagggcgctcatggatcgagatatagtcggtctgtacttctcgatgtcgtctagtattctttgaatgccgggtccgatgtttatgtctgagatggcgctgaataccggtatcaccacgtgaggagtacttttcacctaaattgtgttgatagatatgacggtaaattgtgttgtagctaacacaccattgatgttccttattaaagcgagcggtaatctgctctggtgaccagtgcagatctaagatgtaatgaacaatttgacggcgtaattgtggatggctgtctaatagccgcttcttgtgacaattctgccgcttttgatgatagtcattatctgctttgcttggggaataattacctgcacaacgttttaactcccgtgaaatagtgcttggatttcgccccagtcgtaacgccgccgttagtaaaattaagttagaaaaatagaaaagccatttgtggtaaacttttgaatacctctagacaaaagaaaggacaccacaaatgacctactctcatcttaccacagctgaattcactacaatcgcaaatttcttcactcaggggacgaaagcctacaaggtggcgcaaatgcttaagcgtagtgttgagacgatctaccgtgtctatcgctatctgaagaccggggcaacgattgtcgattaccaacaacagtacgtaagcaataagaagcgttgtggtcgtaagctagcccaattaccgcaggatgaggttgcctacatcaatgagctggtggcacaaggttggacacctgacaccatcattgggcgtggcgaccgatcgattagttgtaatcgacggactctttaccgaatgtttaaacggggtcagtttggctttgacgctaaggatttaccaatgcacggtaatcgtcaccctaatggctatgtggaacatcgggggaaggctggtcaattaggtcggagtatctacgagcgctatgaagattttcccaactacactaaggagtttggccatctcgaaggtgataccgttcaaggtaagcaccatcaaggggcggtcatgaccttagttgagcacttatctaaggtcgaaattatcctaaacgttcacgctaagaaggccgagaacatcaaccgccacctaagtgaatggttaagtaagtttccgcgccacttcttcaagtcgatcacctttgacaacgggaaggagttcgctgggtggcgggagattgccaaccaatttgacatccacacctacttcgccgaggttggtgccccaaatcaacgggggctcaacgagaacaacaatgatcggataagaaaaattgtgttttcgtttttataagtgtcaacttgacaggggatagtaccggtaaagtaatgattcaatcggatttctgggtccgcactcggctcgttaaatggtccctctacagtttgaccattcaggttaacggaatggtaacctgcaatgtaaaccggaaaatgcgggtttaagaaacctgctacaacatccgggtttacaagagttttaacatgcttattaattttaaaaaccaaacggacttcgcttaacaaatgtttacgttacaagccctggttgcttgctctcataatgagaagagccaaaaattaaccagttaatagctaacccaccaacgccgtcattaacgttaagttttcctttcactatgtcaaaaagccggtcagtagaatttttcataaacaagaattcatcagcatcgattactaacaaatacaatcgatcctttcgagcttgccaaagagccttattataagcgtcactctgggttatgtccgtataattggtgtaaattctaaataggactttgtgaaatttgaaaggaacttcattatgccaaaggttgaattaaatttagaagatgacgaattaaaggaactattactaggtgatcgggataaggcaatgcaatcaattatggccaagatccttgatgaaattcttaagtccgaagcgactgagcagattaaagctaaggcttatgaacgttcggatgagcgaaccaattcacggaatggttatcgggctcgtcagcttaccacccgcgtagggtctctagaactacacgttcctaaactccgtcatggcaatttttcaacacagctgttcaaacgctaccagcgtagtgagcaggctgctttgcaaggatgttgattctgcttgcttcaaccagggatattcttcttttaatcgttttagaagattgttcatgccaaaggcattgacaaacttggcgtctggattgttctttcgccgctcaatttgcatattaagcatctgattccacacaaaacgagcgcaaccgaaggtttgcattaaacggtcacgttgctcggaattaggatatatacgcattttcacggctttaagaaccattactttctcccttgactttcaatgtacttttttactacttctaacggtgcaccaccagtactaattaaacaatagctttgggtccaaaaagcggattcccacaactgacgcttaatttctggaaatagtttcttaaccattcgagaacttgatgatttataagcgttcaggaacttagccatctccgtatgcggtgttgcgcggaacaagacatgaacatggtcaatatcatggttccactcttgaagattaataccataagactgaccaactactacaaaacgatgtttcagatactcagatatttcatcgttaatgactttacgccgatatttaacaaccattactaaatgataattgagtagatatactgagtgctgatttctatctaattctattgttatcaccacgatcctttaacatatactaaatataccatagcgcaaaagaaaaagcactatcgtgctttaaggaggcgattcatcccccacttgtcgaagtgggggatgaatcgccaattatggataaaatccttgaacggtatccatttcccaatgaccgaaagtggtgcgagtttccacctcttttggtcgttgggaaatgttcttacctggctgttcacgctttggagttcgaccatgtttggccttagtacgccgagttttctctagaaggtcaatattcttcgttcttaggagtcccttatcaatccagttgtaaatggacctttccgatgcgggaagctttacgtcgtcattaacaagcgattctgcaatcttgagcgcagcgtaaggtgagcatttttgcgaatctaatgattcaaacttgtcatgatccttaaagtcaaattcgcccaacataagatcatcaagcaaattaatgatttcaggagatgattgataaattggtgttctgccacagttagacctgcttttttcataacgttcttgagccgtataagggtcatagtactccttgtagtagcagtaaaccttaccgttattcgactgtttggacattttggtgaccattcctcgcttaatctcacgatcaatggtcccgtgagcaacacctatatactgggcaatcattcggttagagtattcaagctctttaagcacagagatcttaacacgatcatcgatcgtcaggtgagaacctttagatctagtagaaacattagtgtctgtcgtgatatcatttaagtgcgtcattgtacgtatctcctcattttggtttggtcacttaaaatgatacacgatacgtcacaatgacgttttttattttgccgcggtttgtaaaattaagttagaaaaattaaaaaagtcatttgtgatagacttttgaataaccataaacaaaagtaaaggaacatcacaaatgacctataagcatcttaacacacaagaactgacctttatatatcatttttggaaacaaggcaccaaggcttaccttgctgcacgtgctttacgacggagtgctgaaaccatctatcgtgtttaccgttttctgaatcagggaaaaactatcgttcaatatcaggaacattaccatcatcaaaagactaaatgcggtcgtaaatcaattactttaccgaaagatgaacgaaaatatattcaaaagcaagtcaacgctggctggacaccagataccatcattggtcgtaacgagtatcatattagctgtagtatgcgaaccttatatcggatgttcaagcgtggcgagtttgatgtccgtcaattgccaatgaaagggcgtcgtcaccctaatggttacgttgaaacacgcggccgaggacgaaccggacaattaggtcgtaatattgatgagcgatacaacgattatcctaactatcgcaatgaatttggtcacctagaagctgatactgttcaaggaagtaagcatcacggcgcagtcatgactctggttgaacgactctccaaagttgaaatcattcttaacattcatcatcgtactgccgctatctaaactcaccaagttggtgaattatcgccggaattcagaaatcagcttgatgaaggtcattgaatggctgctcacgacaaagttcctgggacgctcgctttatcgagcccatgaaacacctaactttaccagtcgcaccgtcagaaataatttgaacgatggccggatcaattggcaacgcttgatttgtcaagttgggagtcatttaatcaagcatttacgaccgtttattgaccgccggcggcggttagcattgatcattgacgatacactcttttcccgtgagtacgccacccaaaccgaattactagcgcgagtctttgaccatgataaacagttatatattaagggataccgggctttaactttgggttggagtgacgccaatacattcttaccgatcaactttgcattaatgtcttccaagaagccacaaaacgtccttggaaaatcagctaaaacaaccgatcaacgaacaattgctggccggagacgtcgccaagcacagcaaaaaatgaacctcgtttcattgcaacttgtcaagcaagccctcgcaaatggcgttctagctgactatgtgttatttgatagctggtatagctcaccaaaaatgttctatgaattaaccaagttgggattaaacggcgtgggcatgcttaacatagttttaaatagaaactgtggtaaaaattattttcataaggtcgtgcatttgggctatctgatttagatagctcttttttatttggttggctttgatagtgtggtggtgactgctccaagaaataagggtccgtgtttggctcttaggctaatttctaaccagcatccgccaccaggcgatcacttgatggggttagggagctgttgggcgtcctaatccgggactatttgccacgctctccaagttagcgacgacatgtgtcgttagtaactgtgacggtctgcccccctcgtcagaatttgaaaaataacgtctccgtttaaaacaacggcaatgtgtgcgctctttttgtagcggtcagggggcgggggggtgtttcatgctaaaatgtttgtgtatggtaatttgtgagaggcggtctcaggaccgtgtctttaaccaagccgctaaggctagtggaaccactccagaaatgatccatacggatcgtggagcggcatatacgtccaccaattacaacgaagctctccgtcaggagaagggaaggcatagcctatcggcgcctgggacaccagcggataacgccgtaatggaacactggtgggcagacgaatttacaattgaagtgcaacaagtaagaagaaaataaaaaagaactcatagcctgagtcctgtaaaatgaagtcaccacaacaaacatctaaaggagatcttaggctatgagttcgtacaaccatcttaccttaaaagaccgagaatgcatactattaggcgtcactttgaaggacacctatcaagttattgcgcagagggttgggtgttctaaagccaccgtatcgcgcgagatcaaacgcaatggcggtcgtaaggcttactcagccgtcaaggcccaagagaactatcagggacgtcgactaaaaagccgacgtcctaggcttctaactaacttgaagttacgggattttatccttcactgtattgttcaacgtcagtggtccccggaacagatttcaggtcgtttagcccacgaaaacagcgaatggcgtatcagttataacaccatttatcgtgggattgaacgcgataatttaggcatcaaacgtaagagtcacggggctcgtggctttgcccgtaagctccgtcaccgtggtaaaacccgaaaggtcaagggaaccattaaggaacgtcgaggacgatttaacgacgtcccttccgttcaaaacggtccagcaaaatttactatcaatatcgcggacggcaatattcagttaaagcattatacaagcgactgcaggcctcaaaatatcaacccaagcaagcttatcaatacagctgctttgtcgaagcgcacgtcgggaaccaaaaattcaagcttcgcttggtatttgtggctaatcgggcccgtcaagatgactacctagtactggcaacgactcagttaggccttcagccacaagcgatcattcaactatacgcccgaagatggcaaattgagaattactttaaagttgccaagcaatacttgcggctcgacaaatcacaagttcaaaattatgacgggctttgtggccatttagcaattgtcatgatgacttatgacctattagcttggcaagaacggcaaaatcaggatgatcgcaccattggggatttattctttataatgaacgaagccatgccagatattgagttgtctcaagcactggtatggcttctaaattcgttaaaaacgattattaatcatgaagtttatgcaagaagagcccaaattattcagatgatgaatcagttcttcacatttttgccgaaacggttagtttcgtttggaacggtgccggcacgtcccatttggtgaacaagaggtccattaattggtcaacatcgtgctcttcaagagcggtcatggcgccctgtaagagttcataaccggccgctaactgaggatcaaggtccaggccaattcccacccgttcggccatcgttaccttttgtcgtaagtggcgatcatagtactccttagtgtagttaagcgatgcgcttttaagcaagtacagtcgccacgaattcttcaatgcccgatactcacgcgtattaggggcgaattgcttcattactgcgacccggacttggttaaacgcccgcgtaagcattgaaacgatgtggaatcgatccacaaccagctttacgtttgggaagtagcggcgtacaaggccttggtagtaactgtttaagtctgtcgaaactgatttgactcgtttgcgctcctttagcgagaatcgatcaaagtaatgcgtaatactactcttaagccgatcagggagaatttggtagatttgtgaggtatcattatcaacgataatgaagcaatacttcccatgcggaccacggaactcatcaattccggccaatatttattaaagtgcctcggcttgaccggggtgccgctgatgaccaccgtcatcttagccgcctgcccggtcgccgggttagtggttctcttcaccctgcaagctaagggcgatgcccgcccggccacggtcgtgatgagcgtttcaaccctcctgagtttggtcaccatcccgctggtcttttccttgctcgacctcttgtaggggcgctgccggttcatccaccggcggttggtgcttcagccgttccagttccacctttagttccagtatcttgcgttcttctttgacccgcttggtccgttccttggtaacccgggtgaccgtttcgttcaccagcttgtagaccatcaccgccacaatcaagacgatggccacgatataagtatccatagcgattcctcctcttaaatgctattgtatcttcgtcggttacactaataacgtgctcaccaaccgcaggcctagtggctaagtctggccacagaacaccgcgtaccgcgctaacctgtgccctatccttaccccacggcctgcctatggttggtccgcacttccaacattatacatacttaaactttaaatttatctatggattgaagtcaatatttgagacagattttaagagacattcagaaccgcgtttaccttccacagctcaaataaatcattaatcgtgattaataacttatttgaaccatggaaagcattaaatcaggcggccatttggctcgtaagtgttgcgatttcaacttgtaagggggtctggtagcccagtgaactatgaattctcttcctattgtagaaagcatgcacatattcaaaaaggacagcagcggcagtttcataattctcaaagaccggcactggataaacacattcctttttgagggaagcatgaaaagattccattggtgcattatcgtatggacaccccttacagctgtaagagtggcggatatgtagttctgttaaccgttggttgtaatcatcgctggtgtactgtgatcctaagtctgtgtggataatcaggtccccagtaatggttcgatttttaaccgcgctttccagggtctttaagactaaatcagtatccatcttttttgagaatgaatagccgataatttgtcttgagtgcagatggtttttagcaatttcaatcatacggggaaggctttccctttttcaatacccgcaaggtatcaatttacacaaaatattttacactcccgtaaattacctcaaacaggtaatgaatcatcaatgggtatgatgttaattggactagtgacgttattgctaagcttaggtttagtagttataagtagatttactatttgatcatgattgaatgatcgtaagcactccacaacgaaccgggttgaatcttaaccattgatggtatctcagatccctgggttcaaacaaaaatagcgggcgaccgacgcagttttctgcgttagtcgcccgctttggtttctctattaaacacgacacgtggcctgaatttatggagcccccggtaaataagcctcaatatctggcgtgttacgttgtgtgtaaaccgttagtaatggttaaaaatacttaaagacgtccagtttatttaatttttccatttgtacaataccaaaccagatcgtattagcctttgcgcctgccgttggttttgtgaacagacttattctttcgcaccagcgtggtagagtgttatctaaacatagtgagcctagaatgttgttagatcaacgtcctaggctcttttttgttactgtttgcttttgttgggttacggataatttcggttaattttgacaatggttgggtcccgcttgggtcccgttgattgattcacctggacaccttggggacccaaaaggacccaaaattagacaatttaattaattagtttattttcttcccctaaaaaagacaacgcttaaagattatttttaactatttttgattcgatatacaattaaatataattgggataagagattcgttttaagctaaaaataattattttcgatttattttaattcaatatgaattaacgaagttgattagagtcgttttgcaattgataataattgaaataaattaagtttgaatcagtgtcaaagccaaatgtaattaaattaacttgtttttaattacatttgagtcgttatgttgactgttgagtattttaattatttttgattcgatttaggcttaaagacagtttcattaattgttttagagtctaatttgattacattgaaagagaaagaaacgaccgctagcgtcctttacgatggttaccgttccaatacgggtttcagcactgcgagctaagactcgttgatgggaacctttaacacggagccgacctaatttaggcactataacatgcttactatcttcaaaatgtacagttccgttagttaagtatgctgccttctgtttcaaatactggcagttagtttgataacgccaaacgtaacttttccggtgaaacttaggcacacctgcggtatgaactttgcgaaaagcattccaagctttatggtagttttgaatggcattggctttagtcaagctatcgatccttttatcttctaagaactggaaatgattagacatttgtttagcgctttggcgaagctccagttgctcaatccggttctgaatggtatcaatcgggagtttaacctgttttagccgccaaagttccttgttaatagcgaccatttcgttatagatgaatcgactagcatcactattgatcttgataattttcttttgcctgtcgcttggataaatccgcaccttgagtccgtcctgatttataccttgaaaaatgggtgcgtttggcgcgatttacccagcgattttcctaaatgggaaaccgtctattattactggttactttggactaaaacgccatctcctgctggtatcactcctctggataaggttttaaaaaaattgtcagccaacatcggttggctcagaagcgttcagtttatacatcgttcgtcattctagatgctcaaagtgtcaagaataccgatcctgctgaaagtagcggctacgatggtggtaaaaaggtgagtgggattaagcgccatcttgctgtagatatcaatgggctgccgatggcagtccatgtgacaaccgccaatgtttctgagcgtgatggcgccaatgcgctactggcgttaaacaaatcacagtttgacctggttcaacgagtaatggccgatggtggttatactggtaacaactttgctcaatcagttcaggcaatgattaacgctgaagtcattattgctaaacagagtgaccttaggcacggtcaagtgaccccgcaacgctgggttatcgaacgcagttaaaactatgtttactgattttcagtaagaataaaaaatgccgtcatatcaaggttttaaacacccctgaaaatgacggcgaattaaaaaaatgccaacggacggcatatggctttactaactttggtcatttcatcgcccggatccgattgcatcaaatgggaacggaagcagaaaaaaggcggcgccaggtgcaagcaccggccaccgcctaaaatgacccatcaacaggatttgacaaagagccagtttaattgcgcaacaggggtttaaaaacgtctatataaaaattccccgtgttactaacacgaggaataagttactttttgcgtaaggggacgtcggttaaaatccagcacttggtcgtccaaattattgcataaagccgagaccgtacttttagaaagggttgtcccacataacttcttagtaatctcagctactttacgtgttgaaacaccttggattaccatctccattaatgccaaatcaaaggcctgttcactacgctgatagcgtttgaacaattgcgttgaaaaattaccatgcggttaggtaaacggcgtgaatgccaagttcacgcatatacttaccaacagttcgttcagcgatcttatatccttttgagcgaagttcttgggtgattttgccggcaccgtaaatacaaaggcttttgagccaaattgctttaatttcaccttgaataaacttcttccgaagctttcgcggtgattggtgattatgacgcttttctcgttgatagtaaccacttcttgagattccaacataatcacacataccattgatggaagggtgggattccaaagcgtgctgaacgtccatttcttggtataccttttcggtagttacttgctcagaatcccgattgatttttttaatacttcgatcgctccttcagcgtcacgaagttgacgctttagtcgtgcaatctccttgtccttatcgctggcaaaattaccagagccacggccaaactccccagtctcagtaaacagcttaatccatttatgtaatgtactagccccaatacctagattcttacttatttcattcatggtcatgtgatccttgcaggtattcgcccgaaagaatggagtccttaacggtcacccgcttggtattccagaagcagtcctttgacatcaagcgtgaattggttactaagacgtcttcggccccgtcaaaggcgtaattccccactaagtctaagtgatcagcgacgatatgcttggagttcattccaaagtaatccccgttcacctggacgttggttagttcaatatcctcacaggtccacatcgtttcttccacgtgggcgaaatggacattggttagtttaatccccttactccggcggaataacttgggtgcctgaagggttgtgtcctttatggtgatgttattggtgtaccaaattccggaccggcccatttcttcaaagagactgtccgttacggtgacgttctcgtcgttccatagcggatatttgtacttaaagaggacctgatcaagcttgaggtcccgtccctccttaaggagtgattccccatccggaaaaatcacccgtctaacttcagcgttttgtaagtggaatagcggacgctcccctgggtgactgatactacggaacttacttacggtcgtggaaacaaggtacgactgcacgcaatcatagatttgtatgggaactatgcgcttagttacttcatatctccaaccgaaaccgccaaggacgtaattaaagcttttgaattggctaaacagaagaccagtaggttggctccgttaattcatacagatcgtggatctgcctacacttcaagggaattcagtaattaccttatccaaaaccaatgcgtccacagtatgtcagcgccggggaccccggctgataatgcggtaattgagcgctggtggtgtgacttcaaacatctgtggctggcacaccagccagcgcctcaaacgtatgaccaactcttaaagttagtggcagaaggcgttaagtacttcaacaccgttgaaatatccggtaaaagaaagaatctcaccgctgtagattactacagaagtgagattgcataacttaataattttagatttctaaagtgttaccttgacagggggcagtgcctgtctagccattccgatttatctaaacctaaccgatggttgtttttcccacagttaatacagatttgactagtataaaacgccgcaattcacgcatgttagccaaattgtgatcatcaatcaattcacaaacattattcagcaaatcgtctttgtcctcggcgtcctttgattcatgcgtttacctccaatgcagttagatttagatgacttttctgatttacttctttttcatctgtatcctgattatctgataaatgaaagataaaatgactgtgataattgcaaatacaaaagttagtgtgttctttccctgaaataggaacaacactatcgtaattaacgacgtgatgatcgcaactattcgtactaataaatctggtttgttcatgcttcttactcactttcaaatggttggttgttttgctaaatgtagggatgccgtcagctgtggaggctagagcggtatccctctttttattatattcccctcatattaaatccctggagtagttcagaccaagcggctccgttctcggtcggtgcgatactgtagtcaagaacttccttaccgccgtcacttcgaattccgatcgctacgttaacggcttctcgttcaacggtaccacggcgtaacggaatgtaagtagcatcgaggaacacacagacgtactgtgagtacttgaatttgcgctcgtggaactcttcaaccaggtgttccgtccgcttagtgatgtttgaaaccgtggttggtgagtagtagtggccgtacattctctcaaccatatcagcgatttcacgagttgtgacgcccttggagtacatcttgatgaccatttcctccagtccatcagtccgacgcacgtaaggagggaagagggcgttttgaaacttgtttaaccggtcccgtgggatcgtcagattaatttcaccgtactcagtgtcgatcgtgcgggtgtacgtcccgttccggtagttcacgtcgtcaatgcagttagcgtcggatactccctttgtcaattggccgcaaaatacaggcaagcagattgggattgatcttaatactgaaaacttcttaactactagtaatggcgatactgtggctaatccacgctattaccgcataattaagggtcgcttagccaaagcacagcgcatcttatcgcgacgggctcgtcgggccaaacaagaacatcgaccattacggactagtaagaactaccaaaagcaacgcttgttggtggctaaattacacgcccaagtctttgaacgtcgacgtgactttctccacaatgtctcgactacactaatcaagaaccacgatttcgtagccgcagaggaattgcggagtaaaaatatgctgaagaatcatgctttagcgatgagtattgcggacgtaggttggcggactttcttaggaatgttggcttataaagcagaactctaccatcgccaattccttacggtgtagcttaactctgcgaagctgcatcagttccttattgatcgcaaccatttcgttatagataaagcgactagcgtcactgttgattttaatcaactgcttttgttggtcactaggatagcagcgcatttttaggccataatgatatttcatttttgccattgacttcatttgatttcacctcctttattgatatgataacattatatcatgatgtcaatgtattaacaaaggagagcatattatgactaaagaaaaaatcaaagatgccatttatactcgtcgttatatctataatttccattatcatttgatctgggtaactaagtatcgcaatcagacttttacaaccgaggtcttatctaacgaaatgaaagctatcttgcagcaagttgcagatgacaatgacatcgtaatcgaaaagatggaagtcatgccggatcacattgacgaattgtcaaatcaagcgcaactttgtcccgaagaaaacttcaaatggactcttccagcctaagaccttacgtggtcggtgatttaaatccctgacaaacttgtcgatatcttgatcagttagttggtctaggtcggttcctttggggaaatactcacggataagcccgttggtattctcattggttccccgttgttggggcgcatggggatcgggaaaatagactggaatgcttagttcttggctaacttcacggtatcctgcgaattcagttccacggtccggcgtaagcgtccgaacgcgtttaggcgttacggtatgcaggaggtcaatcatcgcttgtgtgacgttcttggcgtttactttgagaacgcgctgagataataaataccgagatttacggtccactaaggttaccagggcatcgcgcatattctccaaatgccattcaaaaccctctataactggctggacaagggctggttggacatcaaacgcgaggtccttccagaccacggtgtgcggtaccgaaagagccacgatggtcgtggtcagtacacacgtggggcgaagtttatcgaccaacgtccggacgaggctaacctgcgtcaagagattggtcattttgaagtcgataccatcctatcaggaaaaaccaggggcgaggtcctagctacctttactgatcgtaagtcccgactaatgattattcgtcgtttaccgggacgtgatagtaaagctatgactaaggcaatcctagagcttaacgaggagttgcgcggcttgatcaagtcaatcaccagcgatcacggtaaggaattcgcaggcttcaaggaaattgaagccttaaaaagaagcgatccgctgaatctttagtcaacgtcacggtaccaattctagtctcgcatattcttttcaaaagccgtgcttgcgaaccggcaacacgtaacagtcctattttaggtactttgacatgactattatctagaaaacagactgtaccgttagttagcaacgcagttttttgccccgggtattgacaattggtttgataccgccagtgataactctttcgatgaaatttgggaacgccagtggcgtgaaccttccgaaaagcattccaagcttttcgatagttctgaatggcattagctttcgtcaaactatcaattcgtttatcttctaagaattgatagtgattagacatttgcttagcgttttggcgcatagttagttgcttaatacgatcctgaactatgtcaatcggaaactttggaaagaaagtctttcctttctcggtgtcttttgatagaatattaaaagatattgatatgctgacttagctcagttggcagagcaacgcactagtaatgcgtaggtcgaaggttcgaatcctttagtcagcactagtaagctttataaagctcaacaaaccttgatatatcagcatttagctagataatatcaaggtttaattttgtttaattaggaatataatgcacacggctgtgcacacagaaaaagtgtgtgtaattaaatgcatcgaaagagagctgtatatactgatataataggcttcacgcctggttttttgtgtgtaaaattatgtttgaaattgatattgaatggtattcctaaattgcaagattaagtgaaccacccggccacgggatttcgaaccacaatttgcgtagatagggacaacttatttgaccaactgaaattgtaatcaaacagcggtcgtctaattaccaacgccttttatgtccccaggttgccatagggacagataagctaggctagtttagctattcccttatcaagaatgtttttagctgcgttccagtcacgaatatggtgaataccacagttaggacaagtccagtttctatcatctaatgttagtttgtccgtcccattagtgcccattacaaagccacaatcgcgacatgtttgggtagtatttcttgggttgattgtgataaattgacgcccataaagctttgctttataagccaacatgccaagaaatgttcgccagccaacgtcagaaatactaagtgcaacttcaaaactccaccgctgttcgagaatgatcccacggacgaattctcttaaattctctgttagaagagttttccgcccccggtgagttagcttcttttcgcagtcttcctgagcttgatcagcgtcatagtatcccttaggacagcgttttagttcatagttgatggttgaaggagctacaccaacttcttcagcaatttgtttttgtgagtaaccaaccttaagcagcgtttggatgacagttctatccgataatgttaaaatatgactcatgggtaatggactcctattgtttatagttttgtcacttaaaacaataccgggtccattgccctttttctatccaaatttttcgtctgggtagaattctatttaatcttacaatctaccgacttcaaaactccaccgctgttcgagaatgatcccacggacgaattctcttaaattctctgttagaagagttttccgcccccggcgagttagcttcttttcgcagtcttcctgagcttgatcagcgtcatagtatcccttaggacagcgctttagttcatagttgatggttgaaggagctacaccaacttctttagcaatttgtttttgtgagtaaccaaccttaagcagcgtttggatgacagttctatccgataatgttaaaatgtgactcatgggtaatggactcctattgtttatagttttgtcacttaaaacaataccgggtccattgccttttttctatccaaatttttcgtctgggtagaattctatttaatcttacaatctaccataaccaatggtaaccaaagttcttgatcatcacgaattgctttcttcccccataaagaaagttcttctgtcgttagctctcccatttttcaccttctactctcgaattgagtattaaatacttcgaataatctctgcttaggtatgaaattaaaatcaatcgaataaagcatgtatcagtcgctgaattctagatttcatcgccgcccttcatttactataacgttcgaccataacaaaaattttcataaagagcatttactcacccccacatacattgggaattcaagttaagtatatatcagtgcaataaaaaagtaactccagttttcggggttgcttttttgcttgtctatattggactttagcaaaaatgaatggtcaactataaatactagtgaagcgttagtgaatgaaatgaaagaaatccttacaacggttgcggcagataacgaaatcgtgattgagcacatggaagtaatgcctgaccacgtccatgtgttgattagttttccacctagtaaagcaccaactagcgctatcaaagccctcaaaggacgcagtgccttcattttcctcaagcgacacccggaaatccgccagtcgcagtattggggtggccacctctggtcccctagctattacatgagtactttagggaatatgagcaaggaggtcgttgagcaatatatcaataatcaaaagtacaatgaaataaaaaaacgccctaaaggacgtaagtagaagcctatccatcccatgactaaagtcacgggattcgccgctacttcccaaacgcaaagctggttgtggatcgattccacatcgtttcaatgcttacgcgggcgtttaaccaagtccgggtcgcagtaatgaagcaattcgaccctaatacgcgtgagtatcgggcattgaagaattcgtggcgactgtacttacttaaaagcacatcgcttaactacactaaggagtactatgatcgccacttacgacaaaaggtaacgatggccgaacgggtgggaattggcctggaccttgatccccagttagcggccggttatgaactcttacagggcgccatgaccgctcttgaagagcacgatgttgaccaattaatggacctcttgttcaccaaatgggacgtgccagcgccgttccaaacgatattaaaattaactagcaccacgggtgatttatagtatattatgtcaaaaggagaagttagatgaacaatcaaatcacactagcgtatttagattatgatgatctagatgctttacaagttgtaagtgttgtcagtttttatgaatcgtttatcgatggcgcagatccacttgatatgcaaggatatttacagacacaattgacaactgaaatatcggcagtagaattggcacagtcaaccagtaaatttattggtattaaggatcatcaaatactcattggttatatgaaagtcaatgatgaaaaagatgctatagagattcaacggatctatctgctcaaagattatcaaaacaaagggttagggcaacgtaatgactggctaacctcattctacaattcgcctgaatttacactttaagtgcaacgctaaaacaaaataaaggactcacaaaggaaatccaaatataataagtttgtctataacttaaaaaagaaggatttctattatgagccactatcaacatcttactataaatgaccgtgaaatgatattggagggccttgcacaaagtaaaactattcgtgagatagcacagaaattaaaacgtgctcctcctacaatttctcgtgaaattaaacggcataagagtgtaaatactggaagatactcaccagataaagcccagaatgattataaattggttagcacactcaccacaaccacaaacgtttgaagacttaaactagtcgtttagcttcggagtatgaatggattttaaaccgatttatccattcacgcttaatcaaggcatgaaacgactcaatgcaggcattatcccaaggataagctttctttgaatagcttaatgtcatgttagctgtaacttgattgtaagcttcagacgtaaactgactaccacgatcactgtgcatgattaatggcttgctaatatggcgactgtgcttagtcttttcaataagtgggatgacattcgatacctccaaggtttcagataagtcccaaccaatgatccgtcgggagtacaagtccataatactggttaaataaacgaatccgtcatgaactggaatataagtggtgtcaatctagactatcggacaccttatgaggtatttatggaacatatcacagaggatcaacgacaacttttttctaacttaaattgacatttcagggtgttaaaacaattgatccattttcaatggttattgtcatatcttggttatcatcgaatttcagttgtttaataatttggctaggaattctagcagctttcgagtttccccactttgctaagcgtgtttgttctttaataagttccatattttcccctcctaaattattattacaagtcaagtatatcccgttatttttttttgaattacttcattttttagttaacgatattttagcctaaattgcaagattaagtgagccacccggccacggggtgggtgacggacacgacggaaattgcctacaacattcgtaagtacaaagtccgtctacacgttgtcctggatctatacggtcaatacccacttagctggattattacgcctacagaaacgagtactggggctattaaagtatttcaaatggccaagcagaaagccggaggtctggcaccgctaatccacactgatcgcggagcagcatatacttccaaagcattcaaccactacttggctagtaataacagccaacatagttactcagccccaggaacaccagctgataatgcggtgatggagcactggtgggctgattttaaatctatctggttagcacggcagtacgatgatgaatattaagaatgatttcaactttggagagtcgttcaaccagagtcatgactgcgccgtgatgcttacttccttgaacagtatcagcttctaggtggccaaattcattgcgatagttaggataatcgttgtatcgctcatcaatattacgacctaattgtccggttcgtcctcggccgcgtgtttcaacgtaaccattagggtgacgacaccctttcattggcaattgacggacatcaaactcgccacgcttgaacatccgatataaggttcgcatactacagctaatatgatactcgttacgaccaatgattggtcgcacaaaagatatcatataaatcaacctttcttggcttagtccgcttacgtatgccttctagatctgtccggattagttcaaattgttcacgagagatgtcgctactataatagtgtgcaaagcttttcatggattaaaaactcctgtttttgatctaatttaactaaaatcaaatcgaatgtcaaagtatccaaacacgttctaagggcacaaaaaaaggcaattcatcacgtccttaaaagaacggctctttgtcaaatcctgttgatgggtcattttaggcggcggccggtgcttgcacctggcgccgccttttttctgcttcacaccaccaacgcgcttaccagtcttagctaatgtttggttttcgcattcagttaaaacggtaatgtagtattgattagcaacagttaggcgaacagtaacgttcttgattttgccttgtggtaaacgtcctaatcgaaagtaaactacccctaatttaggcaacttaatatggtgattatcaatcactttaatgttgtggttaacacatttcgagttatagctctgtgcatactttcgtgacttaaagtgtggaaatttattttgccctttaaaaaaacgctgaaaggcgtcggctagattgcgattagtaaccaccaacgcgcttaccagtcttagctaatgtttggttttcgcattcagttaaaacggtaatgtagtattgattagcaacagttaggcgaacagtaacgttcttgattttgccttgtggcaaacgtcctgatcgaaagtaaactacccctaatttaggcaacttaatatggtgattgtcaatcactttaatgttgtggttaacacatttcgagttatagctctgtgcatactttcgtgacttaaagtgtggaaacttattttgccctttaaaaaaacgctgaaaggcgtcggctagattgcgattagcgtaaaggtcaagctgtggctacttttgtggagcgtaagagtcgcctgacaattgttaaacggctccatggtcgcgatagtcagtccatgactcaagccgtacttgaactagctagtcaacttcaaaacaagatcaagacgcttaccgtggatcatggtaaagagttcgctaactatcagacaattgaacggcaaactggtactcaggtttattttgcccatgcttattcaccacatgaacgcggtagtaatgagaaccgtaaccgagttttgcgacggtttattcccaaaggccaagccattgaagaactttcaacacgtaaagtagctgagattactaagaagttatgtgggacaaccttttctaaaagtacggtctcggctttatgcaataatttggacgaccaagtgctggattttaaccgacgtccccttacgcaaaagtatgcttttgtgtatgccgatgcaattttatttaaggtacaccgtggtcacgttgtgacaagtaatagcttactcgttgcgattggaatcgaccctagcggtcgtcgagaagtgctcggttttgatatcggtgatagtgaatcaaaagctgcatggatggacttctttagtgaacatttaggattaaaatcattacttaatctatccgacggttacaaagagccaattcaccattttgaagataagtatcgtaagaagctacaccattgggaaaagttgcgcagtcgacgctacttattagctaaacaagccattgcttgggattatcacaataaggtcttagctccacggcaattagacgacttcaaaaattaccaaaaagctcgtgtcatggttgctaaatatcgtcaaaaaatcgccaaccaacggttggatcagttacaaaagttcacaaccaagttagttaactgaaacttgaaagtttcatgtggtgaataagcatgggcaaaataaacctgagtacctgttagctgttcaattgtctggtagttagcgaactctttaccatgatccacagtaagcgtcttgagcttgtcttgaagttgactagctagttcaagtacggcttgagtcatggaccgactatcgcgaccatggagccgtttaacaattgtcaggcgacttttacgctccacaaaagtagccacagcttgacctttacgtttaccagaaagtacggtatcagcttcaaagtggccgaattcctggcgagtttcgactttatgaggcaatcttcatttcacagacgttgtctttgaaaataatgacggacgggagacgcaggtcttcattgggacggtctcgcttaaattggatcggtgcccacattgcggctttgcggataccttcattaagaatggccattcttaccaaaccattaagtacctctcaattaacgaaagttgtcccactatgttgcggatcggtaagcaacgcctgagatgtaagaattgccaagattcgttcatggcgaagaccaacgtcgttgataaatactgttccattgccaaagcagttaaacacaaggccgacgttctaccatatgtaattctttttgtatctttcataccaataattatattacattacggttcgatcatgtgccctaagaacgtgtttggatactttgacattcgatttgattttagttaaattagatcaaaaacaggagtttttaatccatgaaaagctttgcacaccattatagtagcgacatctctcgtgaacaatttgaactaatccggacagatctagaaggcatacgtaagcggactaagccaagaaaggttgatttatatgatatcttttgtgtaactctaccacgctggtgtgaaagaataagtctgttcacaaaaccaacggcaggcgcaaaggctaatacgatctggtttggtattgtacaaatggaaaaattaaatagactggacgtctttaagtatttttaaccattactaacggtttacacgcaacgtaacacgccagatattgaggattatttaccgggggctccagaaattcaggccacgtgtcgtgcttaatagagaaaccaaagcgggcgactaacgcagaaaactgcgttggtcgcccgctattttggtatttaggatgttgcttctgtattcagaatacctaacttacagaactccgttcttttaccacggctagtccctagccaacggcttttaatcctctatggagtatattaactgccgcattaatatctcgatcgtgatgagtaccacatttaggacaagtccattctctaatttcaagtggtttcttcccactatggtaaccacacgtgctacagatctgactggtgtaattaggattaacagtaattaactgtttaccgtaccaatcacacttgtattccagtacgcgcacgggggattaaagatattcagttgttcatcgccgacggtttagttggacttcaatctgcgattgaggctaactacccgcaggcgaagtttcaacggtgctgggtccacgcagagcgcaaccttttagggtacgttcgcaaaaacgatcgcagggagattatcaccgactttaaggctattcggcaagcagagaacctacaagccgccaaagaacgattggcggctttcagtgctaagtgggagtccagttataagcgtcgaatcaagatcaatgcagttagcttcagatgaatcttttgttaaagtgtccaaagctactcatggacatgttggaattgatcttaatactgataacttcttaaccgacagtgaaggcaacatagttcctaatccacgatattaccgcactattaaaggcaaattagccaaagaacagcgcattttatctagacggcaacaacgtgcaaaaaaagaacatcgttctttacgagatagtaaaaattatcaaaaacagcgcttgttagtcgctaaactccatgccaatgttgtcattgaaacgcttcataatgaaggacgttccttgcgatacatcgctaactacttaggctttagtaagaccaccatctttaacgaacttcaccggctaaatagtgagtaccaggctgggctagcgcaaactgactttgaacgcaaggttagtcaacgggggcggaagtcttcgctcactaaaaaccttaaacacttgatcgaggaaaaaattcaagtccagaagtggtcccctgaacaagttgcccatgtggtgggggcggaattgcccattattttgcccacccgtatgcgccacatgaacgcggaaccaacgaacggttgaaccgcgagcttcggctatacattccaaagaaccagccaattgagagcgttacggacgaagagctgaccatgatctcaaagtacttaaactggcgtccccggaaatgtttggggtggaaaacgccactccaagtcttctttggtgacttgtccaaaaaattcgattaattgttgcaatctacccgtagattgcaacaattaatcgaatttttcggacaagtcaccaaagaagacttggagtggcgttttccatcccaaacatttccggggacgccaatttaagtactttgagatcatggtcagctcttcgtccgtaacgctctcaattgactggttctttggaatgtgtagccgaagctcgcggttcaaccgttcgttggttccgcgttcatgtggcgcatacgggtgggcaaaataatgggcaattccgtcaattatcttaagtatttcctcttcaaatctgtctagagaagacttaccaccaagaatctttcttgggtaggagttgagcctcaggtttgcttgttcaacgtcaaattcactgaacaattgtaaactggtacctttagtgatacttctacgaaggagccgattgttgttctcgttggtccctcgttgccatggcgagtaagcatcagcatagtatacttggtcaacttcattagcgacctcaaagcggaatgtcaatttaaattagaaatcggctatctgtaatatgcttcatgaatacttctaaaggtgtttggtaattaagtgacttgcgtggaatgttattacggcgtgtcataatttgctggattaattcatcaggtagtgaacgaaaatccatgcccttctttagcccatcacgtcgaataataccattattgttttcgtttaacccccgctgattgggagcaccaacttctgcaaagtaggacggtaagcgtcttgagcttgtcttgaagttgactagctagttcaagtacggcttgagtcatggactgactgtcgcgaccatggagccgtttaacaattgtcaggcgactcttacgttccacaaaagtagccacagcttgacctttacgtttaccagaaagtacggtatcagcttcaaagtggccgaattcctggcgagtttcgactttatgaggaaggtttacttctcaagatgatttatcatcgcttgttgggcctatagctcagttggttagagcgcacgcctgataagcgtgaggtcggtggttcgagtccacttaggcccatcatggggaattagctcagctgggagagcacctgctttgcaagcaggaggtcatcggttcgatcccgatattctccattgctagccgcgaggttagcgagtcgcggtagtaatgagaaccgtaaccgagttttgcgacggttcattcccaagggacaagccattgaagaaccaagtgattaccaactggttcaaatcaattggtatctgaattcacggccacttaaatgccttaattggcatacaccaatcgagatcttcttgcttaatctacgtcactaaattcgttcaagttatttcttgcaatctgctactcaccacaaccacaaacgtttgaagacttagaacagctggtgatagaaggtatctattactttacgcattcctttatttcaggcaaaagaaatggccttaccgcagcagaataccgcttcgtcaaggccaactagtttttattatttaatgtgtcaacttgacagggtacagtaccatccattgcgaccaaacgccgtttggtgtaccaatgagggaagtaaattgatgaacaatattgtgaagctcgttttctgtatttttttgtcttataatattcatgacgtaagtctcctttgtatcttggttttggtcgactaaagtatacaacgcaggagagcttgcgtttatttttttgccaaaaaagccaataaccacacgcctttggcgtgattattagctttcaagtttcaggttaacgagtcactcaaggttttcgctgattatcacaatgtaggtgcagggagtttaaagcgttggatccagcagtatctaactggcggattggctaatttagagcgcccagtacacaatcgccggtaccctaagaagcttaagcttcgtgccgtccgtgattatcgaaatcaccgtcttcctaccaaagaaatcctattaaagtactattactaggtgatcgggataaggccatgcaatcaattatggccaagatccttgatgaaattcttaagtccgaagcgactgagcagattaaagctaaggcttatgaacgttcggatgaacgaaccaattcacggaatggttatcgggttcgtcagcttaccacccgcgtagggtctctagaactacacgttcctaaactccgtacttcgatttgacgacgtaagacttcattcagggtaatatctttgtctgaagatagcgctgcgataatatctttgttaaactggttcatggggaaagcctccgtattctgattggtttttggcgatttcaatcatacggggaaggctttccttttttaataccctcaaggtatcaatttacacaaaatattttacactcccccccaccacatgggcaacttgttcaggggaccacttctggacttgaatcttttcctcgattaagtgtttaaggtttttagtgagctaagacttccgcccccgttgactaaccttgcgttcaaagtcagtttgcgctagctcagcccggtactcactatttagccggtgaagttcgttaaagatggtggtcttactaaaggccaatgagggaagtaaattgatgaacaatattgtgaagctcgttttctgtatttttttgtcttataatattcatgacgtaagtctccttcgtatcttggttttgatcgactaaagtatacaacgcaggagagcttgcgtttatttttttgccaaaaaagccaataaccacacgcctttggcgtgattattagtggtaaacggtcatgtttaagtaccgtggaccagcagcccatttttcattctgttcaatcagtagtgctcccattagtcgcaagacgcttagatcattcgggaatatccggattacacggtcacgacgacggatttcttgattaacccgctcaattgtattattcgtccggagacgcttccttagctactttcaagtttcagttagttaaacaatatgatatcattgtgctagagaaacttaacattaagggtatgttgaaaaatcataaactagctcgagcgattaccaacgctagttggtctaagctagttagtatcttgcagtataaatgtgattgatacggtaaaaaactcattcaggttaatccaactactttcaagtttcagttagttaaacaatatgacatcattgtgctagagaaacttaagattaagggtatgttgaaaaatcataaactagctcgagcgattaccaacgctagttggtctaagctagttagtatcttgcagtataaatgtgattggtacggtaaaaaactcattcaggttaatccagcaggttcttaagaccctccgtaagaacagcgaaggagtgtacaacgcaaccgtattaccgtactccaacggtcgggttgaggggatcaaccgcatgatcaagttaattcaacggacggcatatggctttactaactttggtcatttcatcgcccggatccgattgcatcaaatgggaagttcttaagaccctccgtaagaacagcgaaggagtgtacaacgcaaccgtattaccgtactccaacggtcgggttgaggggatcaaccgcatgatcaagttaatccaacggacggcatatggctttactaactttggtcatttcatcgcccggatccgattgcatcaaatgggaaccctctgggagctggtaaatcaccattaattcgtcaaaactattttctaatttcttcaccaccttagggaactcggtctgccaatctttaaccaattggtcacgccgttcaaccgcttggtcgtacgttggagcattaaataaatctttgagtcggttagcaacttctttacgccttttgatcggtcgatccgagtatgtggttcgtagcctagcaccgcagtcagttcattttgaaggaactgattagcggccacttcgatttgacgacgtaagacttcattcagggtaatatctttgttaaactggttcatggggaaagcctccgtattctgatgtttcttataatcggcaatgctaccgctggtactatagctggattttgaacccgttgttcctgaaattgaatccgtctttaaagtttttccggtcgtatcatcaacgtagctgacactaccttgttgcttatctgctgtataggtgatcgttgtatatacaacgatcacctatacagcagataagcaacaaggtagtgtcagctacgttgatgatacgactggaaaaactttaaagacggactcaatctcaggaacaacgggttcaaaatccagctatagtaccagcggtagcattgccgattataagaaacgatttgactcgtttgcgctcttttagcgagaatcgatcaaagtaatgcgtaatactactcttaagccgatcagggagaatttggtagatttgtgaggtatcattatcaacgataatgaagcaatacttcccctgcggaccacggaactcatcaatatccttgagtgccagaatacttgtacagtcattactaaaatgaaattgacatctctgccaaaggctaccctgaaattgcgtagtgattgcatcctttaagccacaatgagcgtctgaaacaaacatatcaacgttggtaaggccccgctgtttaagtttgccagaaagtacggtatcagcttcaaagtggccgaattcctggcgagtttcgactttatgaggacgctcctcaattgagcggccgtgactgaacgtaccacgcttttctttagcacgatgacgacgaattccatgatcaggcaaatcgggttcccatttgatgcaatcggatccgggcgatgaaatgaccaaagttagtaaagccatatgccgtacaatagccttaaaagttgtcactttaagaaataaaaagtgatgacttttgaggctatttttatgaaaatcacctattcaacgactactggcattcaggtcagttacggcagctgtctgcgctttatcagctacagatcctggcaccactgggctaacaacagcatcaaaggtcgtatcaccatttgtcgctgtccaggctgttgttccagcaccacttgtaataacttcaccagtagaacagctggtgacagaaggtatcgattactttacgcattcctttatttcaggcaaaagaaatgaccttaccgcagcagaataccgcttcggcaaggccaactagtttttattatttaatgtgtcaacttgacagggtacagtaccttcactagttaaattaaaactaagatacaggtcttagttttaatttaatctaccagaagatgccaaagtttcgttactatcattttgcgccattttaattctttcaatataaatagccgccaatcattgtcctcagagtaatctggcgctcctcaatggagcggccgtgattgaacgtaccacgcttttctttagcacgatgacgacgaattccatgatcaggcaaatcgggcaactgtatatcaagccatccttgatcaatccagttatagaccgtcttgtaggcaacttcgtgaatgggattgtcccaactgcgggacccgcctagatcgcgatatcaatgcagctcaagtaattctgaaaaaggggttagctacccaataattaagctatttaggcctgggacgggccttggtcaatagtcgtaacctcgataatatctttgttaaactggttcatggggaaagcctccgtattctgattggttttttagcgatttcaatcatacggggaaggctttccctttttcaataccctcaaggtatcaatttacacaaaatattttacactcccagaagtgcgactaacctcctcgacgagccgtatggctaagctagggtaaaggttatcgcagaatgcgatgttctttgcccgtacttagacactaggctcgtggttaggagcacgttaaaagaagtgtggaccagcctatcatacctgatttgcggcagcttgttcaaactggcggttcagggtattctgtgctacataagtttcctgctcctgcacacgttttctcttaggctgacgatagtccgcttttatactgtgttccttcataattgcgcatgacgggcaatcgtaaatccatattttgaagctatatcatataatgattgcttcaagagttcttctacgtgtccttttaacactttattacgatatttagttccccaaattaaatgataattaagattgtagactgacgttcgaaaatgtttgatcccgatttttttaaatccatgacgttcataaaaacgaatacctgcatgatttttttcataaacagccaaacgtaaataacgtttttgtttcgttttagcataacgattcgcttcatcgagtaacacggactcaaggtgcggatttatccaagcgacaggcaaaagaaaattatcaagatcaatagtgacgctagtcgattcatctataacgaaatggttgcgatcaataaggaactgatgcagcttcgcagagttaagctgagtgtttgaatcacaatttgcatagatacaccactgcgaacagttctacgaaccgtttcgtcttacacggcaattaccaatgcctttagcgtccccaggttgccatagggacgagccaaattaggctaatttacacctgatttgcggcagcttgttcaaactggcggttcagggtattctgtgcttcataagtttcctgctcctgcacacgttttctcttaggctgacgatagtccgctttaatactgtgttccttcataatgcggatctgttgctcatcgtggttattgtgtaaaggtagatcacaatgctcaaagatctggtaaacccggtcctttagattaagggcattgttaatcacattgcgtaataattttaacggtgatttcttgattaagtgattaccaactggttcaaatcaattggtatctgaattcacggccacttaaatgtcttaattggcatacaccaatcgagatcttcttgcttaatctacgtcactaaattcgttcaagttatttctttactaatatcatacttattagcgatctcacgccattcggcaaactctttaccattatcaaatgtgatggacttgaagaggtgccgtggtattttggcaagccattgatcaaggtgagtgttaacacataataataattaaggagcgtggcaatcatgtcgaaggacaaaatcgaagatgccatttatacacggcgttatatttataactttcactaccatttgatttgggtaaccaagtatcgtaatccaacttttgataatcggtactatcccctgtcaagttgacacttataaaaacggctctttgtcaaatcctgttgatgggtcattttaggcggcggccggtgcttgcaccgggcgccgccttttttcagcttccagatatcatactttaataggatttctttggtaggaagacggtgatttcgataatcacggacggcacgaagcttaagcttcttagggtaccggcgattgtgtactgggcgctctaaattagccaattcgtcattatttgatcctccaatttacttccttgattatactaaatcagagtctctatttaacttgtacactttttattctaggcccacacctttaaataataaaagtgtcatctctagaggggtttttgtgttaaaaagctacaataaaaaggccctgcagttaagcagggcctttttagctttaatgggacactattgggacactaaccaacttaaaacgttgatatatcagcgcggagagtgtcaagaatgttgtgtaaaaaaggaaacttcgcccgcatgaattggcgattctaaaacatcgaatcaagcgtgtcgtgacagtccttgaatccccgatgtgctcgattctcaaagcatgatttttaagcaaattcttgctacgcaactcctcggctactactaaatcgtggttcttgattaatgcggtagaaatttgttggagaaaattatgcctttggttcattactcacacgaacagtcgttgtcgataacgttactggtgaagttattacaagtggtgctggaacaaccgcctggacagcgacaaatggtgatacaacctttgatgccgttgttagacgttatcgacaacgactgttcgtgtgaagttgacagaatcagtgtgttgcttggccactacgtgtccattctgatcaacatagctaatcgtctcgttgaccgtcttatcattaaaaagtcagctgaagatccagtaattctcgttctcgcagagagacttaccaggtataaccttgcttttaagatcacatcaaaaacgcctaatgcggtttctagagttattggttatgtccgtataattggtgtaaattctaaataggactttgtgaaatctgaaaggaacttcattatgccaaaggttgaattaaatttagaagatgacgaattaaaggaatctactttgcagaagttggtgctcccaatcagcgggggttaaacgaaaacaataatggtattattcgacgtgatgggctaaatcaataccactaccaaagactatggttcaatttgacgacgtaagacttcattcagggtaatatctttgtctgaagatagcgctgcgataatatctttgttaaactggttcatggggaaagcctccgtattctgatcacttaaatgttcaacttaaattttacaatctgccataatcagtcataaggtcacacctcttactttctggaatttgcgtggtagttaatgatcagaattttaaggctttcacgttcgtaattcgaagggggtgccttttaattaatattagctggaaatcccgtgactttagtcatgggatggataggccactattgagcccctttatggggcttgccttcttcgtcgcgacggtttgaccaaggatcgtgacttacgtaaccttccagatgagttagtgaaccagctcatgagtaagcggaatcgaattccaagaaagtcacaatttgacgacgtaagacttcatcagggtaatatctttgtcggaagatagcgctgcgataatatctttgttaaactggttcatggggaaagcctccgtattctgataagcgaaggagcgcttgatcactgtctaggagtcggccaatggtactaggtgacacaccggtaaacttagacacgtccttttgagagacattactttcaagcatcgttccttcttcgccgcgacggcttgaccaaggatcgtgacttacgcaaccttccagatgagttagtgaaccagctcatgagtaagcggaatcgaattccaagaaagtcacgctcactagtaagtggatatggtcatctttaccaatctccatatgagcaatcgtaaatccatattttgaagctatatcatataatgattgcttcaagacttcttctttaacgttaaagggagttttaactacttaaaaataactatatcacgtcatgactatattgagtataccatataataagcttgcttactatttataaaataacccccaccgatggattgatcttcaattcttttcatgtcttcacgccctccattaatttgattagataatggcagattgtaaaatttaagttgaacatttaagtatgatactcatcttcaagttgctttggtgatttgaatccacagtgactgtgaattctaactgtgaattctaactgtgttgtaaaacgtttcaatgtactgaaa
